United States Patent 11,098,302 (IDENTIFICATION OF POLYNUCLEOTIDES ASSOCIATED WITH A SAMPLE) - sequence listing, part 151

SEQ ID NO: 596645 - DNA, 505 bp, Homo sapiens; identical to SEQ ID NO: 535503
  misc_feature: HIJSMM301C2PH7.8.28.C06.1.454.light.4.raw

SEQ ID NO: 596646 - DNA, 511 bp, Homo sapiens
  misc_feature: HIJSMM301ENFX9.43.9.A09.1.454.light.4.raw
tgtgagtagtcacgaccggtgctcgatttagcgagacgcgcaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggaactgtcaccagtggtcattatccctactggttccagcagaagcctggccaggccccccggacactgatttatgatacaagcaacaaactttcctggacacctgcccgattctcaggctccctccttgggggcaaagctgccctgaccctttcgggtgcgcagcctgaggatgaggctgactattactgcttgctcgcctatgatgctgctcgggttttcggcggagggaccaagttgaccgtcctaggtcagcccaaggctgccccctcggtcactctgttcccgccctcctca

SEQ ID NO: 596647 - DNA, 477 bp, Homo sapiens
  misc_feature: HIJSMM301DW4SD.13.6.A06.1.454.light.4.raw
tcacgtactacacgaccggtgctcgatttagatctactgacagggcagactgagcccaggatcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacaacacccaggcaaagcccccaaaatcatgatttatgatgtcagtaagcggccctcaggggtccctgatcgcttctctgcctccaagtctggcaacacggcctcctgaccatctctgggctccaggctgaggatgagtctgattattactgctgctcatatgcaggcagctacactgtactattcggcggagggaccaagctgaccgtcctaggtcagcccaagctgccccctggtccactctcg

SEQ ID NO: 596648 - DNA, 494 bp, Homo sapiens; identical to SEQ ID NO: 534992
  misc_feature: HIJSMM301B92AH.9.1.A01.1.454.light.4.raw

SEQ ID NO: 596649 - DNA, 464 bp, Homo sapiens; identical to SEQ ID NO: 536640
  misc_feature: HIJSMM301DD1GU.26.78.H01.1.454.light.4.raw

SEQ ID NO: 596650 - DNA, 482 bp, Homo sapiens
  misc_feature: HIJSMM301CVGY3.51.64.F09.1.454.light.4.raw
cgatcgtatacacgaccggtgctcgatttagcgcgtatacaaggggggaactgctcagttaggacccagacggaaccatggaagccccagcgcagcttctcttcctcctgctactctggctcccagacaccactggacaaatagtgatgacgcagtctccaggcaccctgtctgtgtctccaggggaaagagccaccctctcctgcagggccagtcagagtgtttctaacaacctagcctggtatcagcagaagcctggccaggctcccaggctcctcatctatggttcatccaccagggccgctgatatcccagccaggttcagtggcagtgggtctgggacagaattcactctcaccatcagcagcctgcagtctgaagatttgcagttattactgtcagcagtatgataagtggcctccgtacacttttggccaggggaccaggctggagatcaaacgaactgtggctgcaccatctgt

SEQ ID NO: 596651 - DNA, 421 bp, Homo sapiens
  misc_feature: HIJSMM301EL6S5.41.13.B02.1.454.light.4.raw
tctatactatcacgaccggtgctcgatttagtctagcgacttccgcgggcacgaccggtgctcgatttagtacgctgtctttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcgaacgaactgtggctgcaccatctgtcttcatcttcccgccatctgaatatataga

SEQ ID NO: 596652 - DNA, 506 bp, Homo sapiens
  misc_feature: HIJSMM301DY8IE.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaaggacggttgggtgttcggcggagggaccaagctgaccgtcctaggtcagcccaaggctgccccctcggtcactctgttcccgccctcctcg

SEQ ID NO: 596653 - DNA, 484 bp, Homo sapiens; identical to SEQ ID NO: 535400
  misc_feature: HIJSMM301CY9DT.46.26.C04.1.454.light.4.raw

SEQ ID NO: 596654 - DNA, 497 bp, Homo sapiens; identical to SEQ ID NO: 579649
  misc_feature: HIJSMM301ATFVE.26.26.C04.1.454.light.4.raw

SEQ ID NO: 596655 - DNA, 513 bp, Homo sapiens; identical to SEQ ID NO: 541387
  misc_feature: HIJSMM301ATKL5.17.33.C11.1.454.light.4.raw

SEQ ID NO: 596656 - DNA, 508 bp, Homo sapiens; identical to SEQ ID NO: 537954
  misc_feature: HIJSMM301EJFQX.4.57.F02.1.454.light.4.raw

SEQ ID NO: 596657 - DNA, 503 bp, Homo sapiens; identical to SEQ ID NO: 537518
  misc_feature: HIJSMM301ENIZD.8.19.B08.1.454.light.4.raw

SEQ ID NO: 596658 - DNA, 487 bp, Homo sapiens
  misc_feature: HIJSMM301B1003.41.21.B10.1.454.light.4.raw
tctatactatcacgaccggtgctcgatttagtgtcgtcgcaagggggaggaactgctcagttaggacccagagggaaccatggaagccccagctcagcttctcttcctcctgctactctggctcccagataccaccggacaaattgtgttgacacagtctccagccaccctgtctttgtctccaggggaaagagccaccctctcctgcagggccagtcagagtgttagcaaccacttagcctggtaccaacagagacctggccagactcccagactcgtcatctatgatgcatccaagagggccactggcatcccagccaggttcagtggcagtgggtctgggacagacttcactctcaccatcagcagcctagagcctgaagattttgcagtttattactgtcagcagcgtggcgactggcctcgcatcaccttcggccaagggacacgactggagactagacgaactgtggctgcaccatctgtt

SEQ ID NO: 596659 - DNA, 508 bp, Homo sapiens
  misc_feature: HIJSMM301DWZLC.4.10.A10.1.454.light.4.raw
agcactgtagcacgaccggtgctcgatttagcgtcgatctcagggggggtagagaagacaggactcaggacaatctccagcatggccagcttccctctcctcctcaccctcctcactcactgtgcagggtcctgggcccactctgtgctgactcagccaccctcagcgtctgggacccccgggcagagggtcaccatctcttgttctggaagcacctccaacatcggaagtaatcctgtaaactggttccagcaactcccaggaagggcccccaaagtcctcatctatggtcagaatcagcgtccctcaggggtccctgaccgattctctggctccaagtctgacacctcagcctccctggccatcagtgggctccagtctgaggatgaggctgattattactgtgcaacatgggatgacatcctacgtggtgcggtgttcggcggagggaccaagttgaccgtcctgggtcagcccaaggctcgccccctcggtcactctgttcccg

SEQ ID NO: 596660 - DNA, 507 bp, Homo sapiens; identical to SEQ ID NO: 591461
  misc_feature: HIJSMM301A0971.18.78.H01.1.454.light.4.raw

SEQ ID NO: 596661 - DNA, 516 bp, Homo sapiens; identical to SEQ ID NO: 535549
  misc_feature: HIJSMM301EGRNE.14.70.G04.1.454.light.4.raw

SEQ ID NO: 596662 - DNA, 447 bp, Homo sapiens; identical to SEQ ID NO: 535201
  misc_feature: HIJSMM301DR5DJ.18.9.A09.1.454.light.4.raw

SEQ ID NO: 596663 - DNA, 505 bp, Homo sapiens
  misc_feature: HIJSMM301AZKU7.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttggccaagggaccaacggtaggaatacaaacgaactagtggctgcaccatctgtcttctatcttccccg

SEQ ID NO: 596664 - DNA, 461 bp, Homo sapiens; identical to SEQ ID NO: 555355
  misc_feature: HIJSMM301AOW36.22.28.C06.1.454.light.4.raw

SEQ ID NO: 596665 - DNA, 481 bp, Homo sapiens; identical to SEQ ID NO: 535993
  misc_feature: HIJSMM301DVNHP.21.25.C03.1.454.light.4.raw

SEQ ID NO: 596666 - DNA, 501 bp, Homo sapiens; identical to SEQ ID NO: 566032
  misc_feature: HIJSMM301EUMXE.18.26.C04.1.454.light.4.raw

SEQ ID NO: 596667 - DNA, 460 bp, Homo sapiens; identical to SEQ ID NO: 537107
  misc_feature: HIJSMM301EQ1DE.22.28.C06.1.454.light.4.raw

SEQ ID NO: 596668 - DNA, 494 bp, Homo sapiens; identical to SEQ ID NO: 539865
  misc_feature: HIJSMM301CXKTD.9.1.A01.1.454.light.4.raw

SEQ ID NO: 596669 - DNA, 504 bp, Homo sapiens
  misc_feature: HIJSMM301B3ZGJ.21.22.B11.1.454.light.4.raw
  modified_base (430)..(430): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacggggacncaaacatgggatgacaatctgagcggttgggtgttcggcggagggaccaaactgaccgtcctaggtcagcccaa

SEQ ID NO: 596670 - DNA, 492 bp, Homo sapiens
  misc_feature: HIJSMM301ECCAJ.43.30.C08.1.454.light.4.raw
tgtgagtagtcacgaccggtgctcgatttagtctgacgtcaaagggaaagggggcaggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggccagggaccgacggtcggatgtcaagcgaacgtcgtggctgcgaccta

SEQ ID NO: 596671 - DNA, 491 bp, Homo sapiens
  misc_feature: HIJSMM301BDA3D.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcaacaatattataataatccatttaatttcggcggagggaccaaggtggagatcaaacgaactgtggctgcaccatctgtcttcatcttccgccta

SEQ ID NO: 596672 - DNA, 500 bp, Homo sapiens; identical to SEQ ID NO: 536183
  misc_feature: HIJSMM301AY3X7.10.17.B06.1.454.light.4.raw

SEQ ID NO: 596673 - DNA, 486 bp, Homo sapiens; identical to SEQ ID NO: 535043
  misc_feature: HIJSMM301AIJ1K.46.35.D02.1.454.light.4.raw

SEQ ID NO: 596674 - DNA, 511 bp, Homo sapiens; identical to SEQ ID NO: 537464
  misc_feature: HIJSMM301AO8DF.7.34.D01.1.454.light.4.raw

SEQ ID NO: 596675 - DNA, 475 bp, Homo sapiens; identical to SEQ ID NO: 544617
  misc_feature: HIJSMM301BLB2I.13.76.G10.1.454.light.4.raw

SEQ ID NO: 596676 - DNA, 503 bp, Homo sapiens
  misc_feature: HIJSMM301C5BD9.18.78.H01.1.454.light.4.raw
tacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtctaggtcagcccaaggccaaccccatgtca

SEQ ID NO: 596677 - DNA, 508 bp, Homo sapiens; identical to SEQ ID NO: 552440
  misc_feature: HIJSMM301CAHZM.5.24.C02.1.454.light.4.raw

SEQ ID NO: 596678 - DNA, 505 bp, Homo sapiens; identical to SEQ ID NO: 536117
  misc_feature: HIJSMM301CWWOA.8.71.G05.1.454.light.4.raw

SEQ ID NO: 596679 - DNA, 497 bp, Homo sapiens; identical to SEQ ID NO: 550536
  misc_feature: HIJSMM301A3EF9.40.34.D01.1.454.light.4.raw

SEQ ID NO: 596680 - DNA, 487 bp, Homo sapiens; identical to SEQ ID NO: 537220
  misc_feature: HIJSMM301C1PSX.16.53.E09.1.454.light.4.raw

SEQ ID NO: 596681 - DNA, 467 bp, Homo sapiens
  misc_feature: HIJSMM301B8ICZ.5.36.D03.1.454.light.4.raw
atcagacacgcacgaccggtgctcgatttagctgcgtcacgatctctcttgggggagtcagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccgggcagagccccaatgctccttatctctgatgcctccaatttgcacagtggggtcccaccaacgttcagcggcagtggatctgggacagagttcactctcaccatcagcagcctacagcctgacgatgtggcaacttattactgccaacagtatgatagttattggacgttcggccaagggaccaagatagaaatcaaacgaa

SEQ ID NO: 596682 - DNA, 484 bp, Homo sapiens; identical to SEQ ID NO: 536162
  misc_feature: HIJSMM301CBO5R.13.59.F04.1.454.light.4.raw

SEQ ID NO: 596683 - DNA, 511 bp, Homo sapiens; identical to SEQ ID NO: 546062
  misc_feature: HIJSMM301CQLMN.5.58.F03.1.454.light.4.raw

SEQ ID NO: 596684 - DNA, 503 bp, Homo sapiens; identical to SEQ ID NO: 590275
  misc_feature: HIJSMM301DXMG7.15.1.A01.1.454.light.4.raw

SEQ ID NO: 596685 - DNA, 514 bp, Homo sapiens
  misc_feature: HIJSMM301EQNG2.41.30.C08.1.454.light.4.raw
tctatactatcacgaccggtgctcgatttagtctgacgtcaaagggaaaggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgattaccatctcctgctctgggatcaacagcgaccttggtggttataactatgtgtcctggtaccaacaatatccaggcaaaccccccaaagtcatcatttatgatgtcggtagtcggccctccggggtctctagtcgcttctctggctccaagtctggcaacacggcctccctgaccatctctgggctccaggctgaggacgaggctgactattactgcagttcatatacaagcagcagcactggagtcttcggaactgggaccagggtcaccgtcctaggtcagcccaaggccaacccccatgtcactctgtt

SEQ ID NO: 596686 - DNA, 494 bp, Homo sapiens; identical to SEQ ID NO: 559643
  misc_feature: HIJSMM301BPXH4.27.78.H01.1.454.light.4.raw

SEQ ID NO: 596687 - DNA, 444 bp, Homo sapiens; identical to SEQ ID NO: 538511
  misc_feature: HIJSMM301A3DQ4.5.9.A09.1.454.light.4.raw
  modified_base (426)..(426): a, c, t, g, unknown or other

SEQ ID NO: 596688 - DNA, 501 bp, Homo sapiens
  misc_feature: HIJSMM301DWLYY.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtctgcgtcagcccaaggctgccccctcggtcactc

SEQ ID NO: 596689 - DNA, 481 bp, Homo sapiens; identical to SEQ ID NO: 560621
  misc_feature: HIJSMM301BE40B.41.34.D01.1.454.light.4.raw

SEQ ID NO: 596690 - DNA, 508 bp, Homo sapiens; identical to SEQ ID NO: 552440
  misc_feature: HIJSMM301EP62U.5.24.C02.1.454.light.4.raw

SEQ ID NO: 596691 - DNA, 504 bp, Homo sapiens
  misc_feature: HIJSMM301C4VLG.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaatagaggtcaacgaactagtggctgcaccatctgtcttcattcc

SEQ ID NO: 596692 - DNA, 493 bp, Homo sapiens
  misc_feature: HIJSMM301ENVJ1.41.2.A02.1.454.light.4.raw
tctatactatcacgaccggtgctcgatttagactcatctacaggggcagtcccaaccaggacacagcatggacatgagggtccctgctcagctcctggggctcctgctgctctggctctcaggcgccagatgtgacatccagatgacccagtctccatcctccctgtctgcatctttaggagacagagtcaccatctcttgtcaggcgaatgaggacattaacgtttatttaaattggtatcggcagagaccagggaaagcccctgagctcctgatttatgataaatcgaatttgaatccagggtcccatctaggttccgtggaagtggatctgggacagactttactctcaccattagcagcctggagcctgaagatattgcaacatattactgtcaacagtctcatggtctcccccttagtttcggtcggagggaccaaggttgagatcaaacgaaactgtggctgcaccatctgtcttctatcttccccg

SEQ ID NO: 596693 - DNA, 511 bp, Homo sapiens
  misc_feature: HIJSMM301B8DPJ.48.35.D02.1.454.light.4.raw
agtatacatacacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcaccatcggcggcctgcaggctgaagatgtggcagtttattactgtcagcactgttttggcggttctccgactttcggcggagggaccaaggtggaggtcaaacgaactgtggctgcaccatctgtcttcta

SEQ ID NO: 596694 - DNA, 490 bp, Homo sapiens
  misc_feature: HIJSMM301BX4AB.41.2.A02.1.454.light.4.raw
tctatactatcacgaccggtgctcgatttagactcatctacaggggcagtcccaaccaggacacagcatggacatgagggtccctgctcagctcctggggctcctgctgctctggctctcaggcgccagatgtgacatccagatgacccagtctccatcctccctgtctgcatctttaggagacagagtcaccatctcttgtcaggcgaatgaggacattaacgtttatttaaattggtatcggcagagaccagggaaagcccctgagctcctgatttatgataaatcgaatttgaatccagggtcccatctaggttccgtggaagtggatctgggacagactttactctcaccattagcagcctggagcctgaagatattgcaacatattactgtcaacagtctcatggtctcccccttagtttcggcggagggaccaaggttgagatcaaacgaactgtggctgcaccatctgtcttcatcttccccg

SEQ ID NO: 596695 - DNA, 484 bp, Homo sapiens; identical to SEQ ID NO: 535441
  misc_feature: HIJSMM301ARC7W.26.60.F05.1.454.light.4.raw

SEQ ID NO: 596696 - DNA, 515 bp, Homo sapiens
  misc_feature: HIJSMM301CIEM1.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccagggcagcctcctaaactgctcattaactgggcatctacccggcaatccggggtccctgaccgattcagtggcagcgggtctgggacagatttcactctcaccatcagcagcctgcaggctgaagatgtggcagtttattactgtcaactagttttctcgggcgttcggccgaacggaaccgaaggtaggaaatacaaaacgaacctagtggcgtgcaccactctgtcttctatcttcccccg

SEQ ID NO: 596697 - DNA, 507 bp, Homo sapiens; identical to SEQ ID NO: 565672
  misc_feature: HIJSMM301AOPVR.8.28.C06.1.454.light.4.raw

SEQ ID NO: 596698 - DNA, 503 bp, Homo sapiens
  misc_feature: HIJSMM301DAJWZ.10.68.G02.1.454.light.4.raw
catagtagtgcacgaccggtgctcgatttagtcgatagtgaagggaaagggggtgtgggctcaggaggcagagctctgggaatctcaccatggcctggacccctctcctgctccccctcctcactttctgcacagtctctgaggcctcgtatgaactgacacagccaccctcggtgtcagtgtccccaggacagactgccaggatcagctgctctggagatgcattgccaacaaaatatgcttattggtacgagcaaaagccaggccaggcccctgtcttgttgatatatgaggacaccaagcgaccctccggaatttctgagagattctccggctccagctcagggacagtggcctccttgactatcagtgggcccgagggggtcgatgaggctgactactactgtttctcgactgacttcactggtaaacgttggctgttcggcggagggaccaagctgaccgtcctgcgtcagcccaaggctcgcccctcggtcactccg

SEQ ID NO: 596699 - DNA, 501 bp, Homo sapiens; identical to SEQ ID NO: 535746
  misc_feature: HIJSMM301B9W3C.18.11.A11.1.454.light.4.raw

SEQ ID NO: 596700 - DNA, 505 bp, Homo sapiens
  misc_feature: HIJSMM301EUUBA.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctaggtcagcccaaggcctgccccccg

SEQ ID NO: 596701 - DNA, 481 bp, Homo sapiens; identical to SEQ ID NO: 551571
  misc_feature: HIJSMM301CBDP1.41.60.F05.1.454.light.4.raw

SEQ ID NO: 596702 - DNA, 484 bp, Homo sapiens; identical to SEQ ID NO: 535400
  misc_feature: HIJSMM301EF7LF.46.26.C04.1.454.light.4.raw

SEQ ID NO: 596703 - DNA, 521 bp, Homo sapiens
  misc_feature: HIJSMM301DLFXK.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccacgggaccgaacggtggaaggtacaaacgaactacgtaggcgtgcgaccactactgtcttctactcttcccgtcccact

SEQ ID NO: 596704 - DNA, 518 bp, Homo sapiens; identical to SEQ ID NO: 555949
  misc_feature: HIJSMM301AUEF8.41.25.C03.1.454.light.4.raw

SEQ ID NO: 596705 - DNA, 488 bp, Homo sapiens; identical to SEQ ID NO: 542699
  misc_feature: HIJSMM301D9IWW.12.51.E07.1.454.light.4.raw

SEQ ID NO: 596706 - DNA, 496 bp, Homo sapiens; identical to SEQ ID NO: 559735
  misc_feature: HIJSMM301D1NLH.13.38.D05.1.454.light.4.raw

SEQ ID NO: 596707 - DNA, 488 bp, Homo sapiens; identical to SEQ ID NO: 543022
  misc_feature: HIJSMM301DZTOX.9.59.F04.1.454.light.4.raw

SEQ ID NO: 596708 - DNA, 493 bp, Homo sapiens; identical to SEQ ID NO: 556087
  misc_feature: HIJSMM301BZKWA.27.78.H01.1.454.light.4.raw

SEQ ID NO: 596709 - DNA, 494 bp, Homo sapiens; identical to SEQ ID NO: 534992
  misc_feature: HIJSMM301BOYXY.9.1.A01.1.454.light.4.raw

SEQ ID NO: 596710 - DNA, 498 bp, Homo sapiens; identical to SEQ ID NO: 547685
  misc_feature: HIJSMM301DAYCE.19.10.A10.1.454.light.4.raw

SEQ ID NO: 596711 - DNA, 486 bp, Homo sapiens; identical to SEQ ID NO: 535043
  misc_feature: HIJSMM301EMZ4S.46.35.D02.1.454.light.4.raw

SEQ ID NO: 596712 - DNA, 497 bp, Homo sapiens
  misc_feature: HIJSMM301EAGNJ.22.27.C05.1.454.light.4.raw
acatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctccttcagacgttcggccaagggaccaaggtggaaatcaaacgaactgtggctgcacc

SEQ ID NO: 596713 - DNA, 494 bp, Homo sapiens; identical to SEQ ID NO: 535828
  misc_feature: HIJSMM301DJE8N.3.36.D03.1.454.light.4.raw

SEQ ID NO: 596714 - DNA, 496 bp, Homo sapiens; identical to SEQ ID NO: 595016
  misc_feature: HIJSMM301CJBPJ.10.33.C11.1.454.light.4.raw

SEQ ID NO: 596715 - DNA, 505 bp, Homo sapiens
  misc_feature: HIJSMM301EF5LT.48.13.B02.1.454.light.4.raw
agtatacatacacgaccggtgctcgatttagtctagcgacttccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgacccatctctgggctccaggctgaggacgaggctgattattactgcacctcatatacaagcagcagcactctcgtggtattcggcggagggaccaagctgaccgtcctaggtcagcccaaggctgccccctcggt

SEQ ID NO: 596716 - DNA, 486 bp, Homo sapiens; identical to SEQ ID NO: 535043
  misc_feature: HIJSMM301AV0NW.46.35.D02.1.454.light.4.raw

SEQ ID NO: 596717 - DNA, 521 bp, Homo sapiens; identical to SEQ ID NO: 536990
  misc_feature: HIJSMM301DA87Q.27.23.C01.1.454.light.4.raw
  modified_base (517)..(517): a, c, t, g, unknown or other

SEQ ID NO: 596718 - DNA, 495 bp, Homo sapiens; identical to SEQ ID NO: 535596
  misc_feature: HIJSMM301B9B2T.10.79.H02.1.454.light.4.raw

SEQ ID NO: 596719 - DNA, 501 bp, Homo sapiens; identical to SEQ ID NO: 536142
  misc_feature: HIJSMM301CBALD.15.1.A01.1.454.light.4.raw

SEQ ID NO: 596720 - DNA, 501 bp, Homo sapiens; identical to SEQ ID NO: 544781
  misc_feature: HIJSMM301DG8ER.11.31.C09.1.454.light.4.raw

SEQ ID NO: 596721 - DNA, 521 bp, Homo sapiens; identical to SEQ ID NO: 539470
  misc_feature: HIJSMM301EGVE0.27.23.C01.1.454.light.4.raw

SEQ ID NO: 596722 - DNA, 497 bp, Homo sapiens
  misc_feature: HIJSMM301AT2LF.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcacctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaaggaccaaggtggaaatcaaacgaactgtggctgcacc

SEQ ID NO: 596723 - DNA, 477 bp, Homo sapiens; identical to SEQ ID NO: 537678
  misc_feature: HIJSMM301EB6US.12.1.A01.1.454.light.4.raw

SEQ ID NO: 596724 - DNA, 508 bp, Homo sapiens
  misc_feature: HIJSMM301EZW8Y.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggagggctgaggatgttggggtttattactgcatgcaaactacacacggccgctcactttcggcggagggaccaaggtggagatcaaacgaaactgtggctgcaccatctgtt

SEQ ID NO: 596725 - DNA, 492 bp, Homo sapiens; identical to SEQ ID NO: 538317
  misc_feature: HIJSMM301CZQ11.10.17.B06.1.454.light.4.raw

SEQ ID NO: 596726 - DNA, 502 bp, Homo sapiens; identical to SEQ ID NO: 536604
  misc_feature: HIJSMM301C7S1O.27.78.H01.1.454.light.4.raw

SEQ ID NO: 596727 - DNA, 506 bp, Homo sapiens
  misc_feature: HIJSMM301ERFTL.51.23.C01.1.454.light.4.raw
cgatcgtatacacgaccggtgctcgatttagtacacgtgattagggattgggggaggaactgctcagttaggacccagagggaaccatggaagccccagctcagcttctcttcctcctgctactctggctcccagataccatcggggaaactgtgttgacacagtctccagccaccctgtctttgtctccaggggaaagagccaccctctcctgcagggccagtgagagtattgacatcttcttggcctggtaccaacagaaacctggccaggctccccgactcctcatttatgatgcatccaaaagggtcgttggcatcccagccaggttcagtggcagtgggtctgggacagaattcactctcaccatcaccagactagagcctgaagattttgcagtttattactgtcagcagcgtaacaactggctctctttcggcggagggaccaaaggtggagatcaaaacgaactgtggctgcaccatctgtcttcatcttcccgccat

SEQ ID NO: 596728 - DNA, 521 bp, Homo sapiens
  misc_feature: HIJSMM301C5DOE.12.71.G05.1.454.light.4.raw
atacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagcccaaggctgccccctcggtcactctcgttcccgccct

SEQ ID NO: 596729 - DNA, 504 bp, Homo sapiens
  misc_feature: HIJSMM301BHXGU.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactggggctcaggcggaagatgaggctgactattactgtaactcccgggacagcagtgctgaccgaggtggtattcggcggagggacccacctgaccgtcttaggtcagcccaaggctcgccccctcggtcta

SEQ ID NO: 596730 - DNA, 503 bp, Homo sapiens
  misc_feature: HIJSMM301BMFBY.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtctacgtcagcccaaggccaactccactgtcact

SEQ ID NO: 596731 - DNA, 467 bp, Homo sapiens; identical to SEQ ID NO: 536331
  misc_feature: HIJSMM301CN3D5.48.47.E03.1.454.light.4.raw

SEQ ID NO: 596732 - DNA, 498 bp, Homo sapiens; identical to SEQ ID NO: 536879
  misc_feature: HIJSMM301DPKC6.22.14.B03.1.454.light.4.raw

SEQ ID NO: 596733 - DNA, 521 bp, Homo sapiens; identical to SEQ ID NO: 539470
  misc_feature: HIJSMM301DAQ5N.27.23.C01.1.454.light.4.raw

SEQ ID NO: 596734 - DNA, 494 bp, Homo sapiens; identical to SEQ ID NO: 537418
  misc_feature: HIJSMM301COAFX.9.1.A01.1.454.light.4.raw

SEQ ID NO: 596735 - DNA, 500 bp, Homo sapiens
  misc_feature: HIJSMM301BG0B8.48.34.D01.1.454.light.4.raw
agtatacatacacgaccggtgctcgatttagatcgtctgtgttgggtttggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgattattattgctgctcatatgcaggtggtactacttgggtgttcggcagagggaccaagctgaccgtcctaggtcagcccaaggctgcccccc

SEQ ID NO: 596736 - DNA, 486 bp, Homo sapiens; identical to SEQ ID NO: 535043
  misc_feature: HIJSMM301DBXY6.46.35.D02.1.454.light.4.raw

SEQ ID NO: 596737 - DNA, 495 bp, Homo sapiens; identical to SEQ ID NO: 535486
  misc_feature: HIJSMM301EKKK2.26.72.G06.1.454.light.4.raw

SEQ ID NO: 596738 - DNA, 481 bp, Homo sapiens; identical to SEQ ID NO: 539712
  misc_feature: HIJSMM301E0I3C.51.60.F05.1.454.light.4.raw

SEQ ID NO: 596739 - DNA, 486 bp, Homo sapiens; identical to SEQ ID NO: 535043
  misc_feature: HIJSMM301AM2OH.46.35.D02.1.454.light.4.raw

SEQ ID NO: 596740 - DNA, 501 bp, Homo sapiens
  misc_feature: HIJSMM301C36BM.18.26.C04.1.454.light.4.raw
tacgagtatgcacgaccggtgctcgatttagtctagcgactttgggtttgggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccaaggtagagatcaaaggaactgtggctgcacatctgtcttcatcttcccgccta

SEQ ID NO: 596741 - DNA, 478 bp, Homo sapiens; identical to SEQ ID NO: 541545
  misc_feature: HIJSMM301DZUVH.10.74.G08.1.454.light.4.raw

SEQ ID NO: 596742 - DNA, 500 bp, Homo sapiens; identical to SEQ ID NO: 539795
  misc_feature: HIJSMM301DS5HT.22.38.D05.1.454.light.4.raw

SEQ ID NO: 596743 - DNA, 499 bp, Homo sapiens
  misc_feature: HIJSMM301CE60O.8.2.A02.1.454.light.4.raw
  modified_base (469)..(469): a, c, t, g, unknown or other
  modified_base (472)..(472): a, c, t, g, unknown or other
  modified_base (475)..(475): a, c, t, g, unknown or other
  modified_base (479)..(479): a, c, t, g, unknown or other
  modified_base (483)..(483): a, c, t, g, unknown or other
  modified_base (487)..(487): a, c, t, g, unknown or other
  modified_base (497)..(497): a, c, t, g, unknown or other
ctcgcgtgtccacgaccggtgctcgatttagactcatctacagggggaggaactgctcagttaggacccagagggaaccatggaagccccagctcagcttctcttcctcctgctactctggctcccaggtaccaccggagagattgtgttgacgcagtcgccagccaccctgtctttgtctccaggggacagagtcaccctctcctgtagggccagttatggtgttggcggctacttagcctggtaccaaacaaaaacgtggccaggctcccaggctcctcatctatgaagcatccaccagggccactggcatcccagccaggttcaatggcagtgggtctgggacagacttcactctcaccatcagcagcctggagcctgaagatattgcagtttattactgtcagcagcgtagcaaactggcctttcacttcgtccgggaccggaaccgagaagtacaagaactaangtncgncacntctntctntctccgtccnct

SEQ ID NO: 596744 - DNA, 489 bp, Homo sapiens; identical to SEQ ID NO: 571546
  misc_feature: HIJSMM301B89IT.12.88.H11.1.454.light.4.raw

SEQ ID NO: 596745 - DNA, 509 bp, Homo sapiens
  misc_feature: HIJSMM301AXJM5.12.18.B07.1.454.light.4.raw
atacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccaggggaaagagcaaccctctcctgcagggccagtcagagtgttaacagatacttagcctggtaccagcagagacctggccaggctcccaggctcctcatctatgatacattgaagagggccactggcatctcaggcagattcaatggcagtgggtctgggacagacttcactctccaccctcaccagcctagacgcctgaagtattttggaatttattactgtacaacagcgtagcaactggcctcccactttcggcggacgggaccgaaggtaggagatacaagcgaactgtggctgcaccatctgtcttcactcttcccgccta

SEQ ID NO: 596746 - DNA, 506 bp, Homo sapiens; identical to SEQ ID NO: 534969
  misc_feature: HIJSMM301C9ZEP.18.37.D04.1.454.light.4.raw

SEQ ID NO: 596747 - DNA, 482 bp, Homo sapiens
  misc_feature: HIJSMM301B0KBX.49.34.D01.1.454.light.4.raw
agtcgagagacacgaccggtgctcgatttagatcgtctgtgttgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataattactggctcgttttggccaggggaccaagctggagatcaagcgaactgtggctgcaccat

SEQ ID NO: 596748 - DNA, 492 bp, Homo sapiens
  misc_feature: HIJSMM301AXQMP.16.68.G02.1.454.light.4.raw
tgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaactgtggctgcaccatctgtcttt

SEQ ID NO: 596749 - DNA, 519 bp, Homo sapiens
  misc_feature: HIJSMM301ESTL8.7.86.H09.1.454.light.4.raw
  modified_base (447)..(447): a, c, t, g, unknown or other
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtcccccgnggacgttcggccaagggaccaaggtggcaatcaaccgaactgtggctgcaccatctgtcttcatcttccccg

SEQ ID NO: 596750 - DNA, 497 bp, Homo sapiens; identical to SEQ ID NO: 535664
  misc_feature: HIJSMM301EYMZD.22.14.B03.1.454.light.4.raw

SEQ ID NO: 596751 - DNA, 508 bp, Homo sapiens
  misc_feature: HIJSMM301AUWBQ.2.76.G10.1.454.light.4.raw
  modified_base (463)..(463): a, c, t, g, unknown or other
acgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtttgtgctgactcagccaccctcagcgtctgggtcccccgggcagagggtcaccatctcttgttctggaggcacctccaacatcgggcgtgataatgtgtactggtacaagcaggtcccaggaaccgacccccaaactcctcatctctcacaataatcagcggccctcaggagtccctgaccgattctctgcctccaagtccggcacctcagcctccctggccatcagtgggctccgggccgaggatgaggctgattattactgtgcaggatgggatgacaacctgggtncttatctcttcggacctgggaccaaggtcaccgtccttggtcacg

SEQ ID NO: 596752 - DNA, 503 bp, Homo sapiens
  misc_feature: HIJSMM301BY5LB.9.12.B01.1.454.light.4.raw
  modified_base (429)..(429): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttcncgggcttcggccaacgggaccgaacggtggaaatcaaacgaactgtgctgcaccatctgtcttcatcttccccg

SEQ ID NO: 596753 - DNA, 488 bp, Homo sapiens; identical to SEQ ID NO: 535990
  misc_feature: HIJSMM301B29GW.11.28.C06.1.454.light.4.raw

SEQ ID NO: 596754 - DNA, 507 bp, Homo sapiens; identical to SEQ ID NO: 575276
  misc_feature: HIJSMM301BM4NJ.48.34.D01.1.454.light.4.raw

SEQ ID NO: 596755 - DNA, 503 bp, Homo sapiens; identical to SEQ ID NO: 535140
  misc_feature: HIJSMM301EF252.18.37.D04.1.454.light.4.raw

SEQ ID NO: 596756 - DNA, 494 bp, Homo sapiens; identical to SEQ ID NO: 534992
  misc_feature: HIJSMM301ENFZ2.9.1.A01.1.454.light.4.raw

SEQ ID NO: 596757 - DNA, 459 bp, Homo sapiens
  misc_feature: HIJSMM301BSG30.48.77.G11.1.454.light.4.raw
agtatacatacacgaccggtgctcgatttagctagtcactcaagggaaagggaccagagccagtctagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggccaaccccactgtcactctcgttcccaccctcctctactgtatact

SEQ ID NO: 596758 - DNA, 532 bp, Homo sapiens
  misc_feature: HIJSMM301E3V5Q.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaaatcggcccccaggggtttcgttgatcgcttctatggctccaagtctgcctacacggcctccctcgaccatctccgggctccagcctgaggacgaggctgattattattgtagttcatatacaaccagtgacacttgggtggttcggtcggagggaccgaggctgaccgtcctaggtcagcccaacggctcgccccctccggtcactctgttccccgccct

SEQ ID NO: 596759 - DNA, 519 bp, Homo sapiens
  misc_feature: HIJSMM301AKCG6.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcgccgacggaccgaacggtaggaagtacgaaacgaaacgtagtggcgtgcgaccactctgtcttctactcttcccgtccact

SEQ ID NO: 596760 - DNA, 487 bp, Homo sapiens; identical to SEQ ID NO: 536206
  misc_feature: HIJSMM301EB4Z1.47.38.D05.1.454.light.4.raw

SEQ ID NO: 596761 - DNA, 510 bp, Homo sapiens
  misc_feature: HIJSMM301CS7O7.9.52.E08.1.454.light.4.raw
tgatacgtctcacgaccggtgctcgatttagtcgagctctcagagagaaagggggaggaactgctcagttaggacccagagggaaccatggaagccccagcccagcttctcttcctcctgctactctggctcccagaaaacgccggagaaattgtgttggcacagtctccagccaccctgtctatgtctccaggggaaagagccaccctctcctgcagggccagtcagagtgttggtacgtccttactctggtaccaacaaaaacctggccaggctcccaggctcctcatctatgatgcatccaccagggccactggcatccccgccagattcagtggcagtgggtctgggacagacttcactctcaccatcagcagcctggaccctgaagattttgcagtttattactgtcagcagcggaccaattggcccctctcccctcactttcggcgggggaccaaggtggaggctcaaacgaactgtggctgcaccatctgtcttcatcttccg

SEQ ID NO: 596762 - DNA, 510 bp, Homo sapiens
  misc_feature: HIJSMM301B3BS4.22.36.D03.1.454.light.4.raw
acatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaattagcgccactctcgtggtttcggcggaggcaccgaagtgaccgtcctcggtcagcccaaggctgccccctcggtcact

SEQ ID NO: 596763 - DNA, 497 bp, Homo sapiens; identical to SEQ ID NO: 536371
  misc_feature: HIJSMM301BLUSR.16.78.H01.1.454.light.4.raw

SEQ ID NO: 596764 - DNA, 501 bp, Homo sapiens; identical to SEQ ID NO: 535746
  misc_feature: HIJSMM301BG8DX.18.11.A11.1.454.light.4.raw

SEQ ID NO: 596765 - DNA, 509 bp, Homo sapiens
  misc_feature: HIJSMM301DIS53.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgccacggaccgaaggtaggaagtacaacgaactagtggcgtgcaccactctgtcttctactcttcccgccact

SEQ ID NO: 596766 - DNA, 510 bp, Homo sapiens
  misc_feature: HIJSMM301D6FNC.16.66.F11.1.454.light.4.raw
tgtactactccacgaccggtgctcgatttagtcacgcgagaagggtgagaagtagtggagcatcccactatggcctgggctccactacttctcacctcctcgctcactgcacaggttcttgggccaatttctactgactcagcccactctgtgtcggagtctccgggaagacggtaaccatctcctgcacccgcagcagtggcacctttgccggctattatgtgcagtggttccagcagcgcccgggcagtgcccccaccagagtgatctatgaggataacctatggccctctggggtcccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctcggtcactctgttcccgccctcctcgagtagtaca

SEQ ID NO: 596767 - DNA, 496 bp, Homo sapiens
  misc_feature: HIJSMM301BPBQF.17.40.D07.1.454.light.4.raw
cgtagactagcacgaccggtgctcgatttagtgatagagcgtaacaacagagggggtggtagctcaggaagcagagcctggagcatctccactatggcctgggctccactacttctcaccctcctcgctcactgcacaggttcttgggccaactttatgctgactcagcccctctctgtgtcggggtctccggggaagacaataaccatctcctgcacccgcagcagtggcaacattggcagccaatatgtgcagtggtaccagcagcgcccgggcagttcccctagaactgtgatctatgaagatactgtcagaccctccgggatccctgatcggttctctggctccgtcgacagttcctccaactctgcctccctcaccatctctggactgacgactgaggacgagggtgactactactgtcactcttatgatgacatttatgaggcgatattcggcggagggacaaagggtgaccgtgctaggtcaagccccg

SEQ ID NO: 596768 - DNA, 514 bp, Homo sapiens
  misc_feature: HIJSMM301AENNV.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccacctttcggtccctcgggtaccgaaacgtaggatatcaaacgaaactagtggcgtgcaccatctgtt

SEQ ID NO: 596769 - DNA, 495 bp, Homo sapiens
  misc_feature: HIJSMM301DUZGZ.43.49.E05.1.454.light.4.raw
tgtgagtagtcacgaccggtgctcgatttagagcgactagcaacacacaaagggggaagagctgctcagttaggacccagagggaaccatggaaaccccagcgcagcttctcttcctcctgctactctggctcccagataccaccggagaaattgtgttgacgcagtctccaggcaccgtgtctttgtctccaggggaaagagccaccttctcttgcagggccagtcagagtgttagcagcaactacttagcctggtaccagcagaaacctggccaggctcccaggctcctcatctatggtgcatccaccagggccactggcatcccagacagattcagtggcactgggtctgggacagacttcactctcaccatcagcagactggaacctgaagattttgcaatttattactgtcagcagtatgcctggtcgcctccggccctcactttcggcggagggaccaaggtggagatcaaacgaactgtggctgcacc

SEQ ID NO: 596770 - DNA, 490 bp, Homo sapiens; identical to SEQ ID NO: 554041
  misc_feature: HIJSMM301DCMYB.21.65.F10.1.454.light.4.raw

SEQ ID NO: 596771 - DNA, 496 bp, Homo sapiens; identical to SEQ ID NO: 535109
  misc_feature: HIJSMM301B9B15.16.78.H01.1.454.light.4.raw

SEQ ID NO: 596772 - DNA, 506 bp, Homo sapiens
  misc_feature: HIJSMM301DVET5.40.41.D08.1.454.light.4.raw
tctagcgactcacgaccggtgctcgatttagtcacgcgagaaagggaaagggggagagactgaagaacccagcattgcagcagctccaccatggcctgggctcctctgctcctcaccctcctcagtctcctcacagggtccctctcccagcctgtgctgactcagccaccttctgcatcagcctccctgggagcctcggtcacactcacctgcaccctgagcagcggctacagtaattataaagtggactggtaccagcagagaccagggaagggcccccggtttgtgatgcgagtgggcactggtgggattgtgggatccaagggggatggcatccctgatcgcttctcagtcttgggctcaggcctgaatcggtacctgaccatcaagaacatccaggaagaggatgagagtgactaccactgtggggcagaccatggcaggtgggagcaacttcggggtgttcgggcggagggaccaaggctgaccgtcctaggtcagccccg

SEQ ID NO: 596773 - DNA, 490 bp, Homo sapiens
  misc_feature: HIJSMM301AUV9O.52.83.H06.1.454.light.4.raw
cgcagtacgacacgaccggtgctcgatttagatcacgtgcgtcgcggggctgggcctcaggaagcagcatcggaggtgcctcagccatggcatggatccctctcttcctcggcgtccttgcttactgcacaggatccgtggcctcctatgacctgactcagccaccctcagtgtccgtgtctccaggacagacagccaccatcacctgctctggagataaattggggggaaaatatgcttgctggtatcaacagcggccaggccagtcccctgtactggtcatctatctgaatagtaggcggccctctgggatccctgaccgattctctggctcccactctgggaacacagccactctgaccatcagcgggacccaggctttggatgaggctgactattactgtcaggcgtgggacaccatcactggagtaatattcggcggagggaccaggctgaccgtcctaggtcagcccaaggctgccccctcggt

SEQ ID NO: 596774 - DNA, 493 bp, Homo sapiens; identical to SEQ ID NO: 535614
  misc_feature: HIJSMM301DPQ7F.9.1.A01.1.454.light.4.raw

SEQ ID NO: 596775 - DNA, 416 bp, Homo sapiens; identical to SEQ ID NO: 535308
  misc_feature: HIJSMM301DPS0F.16.46.E02.1.454.light.4.raw

SEQ ID NO: 596776 - DNA, 494 bp, Homo sapiens; identical to SEQ ID NO: 534994
  misc_feature: HIJSMM301CGBAD.27.78.H01.1.454.light.4.raw

SEQ ID NO: 596777 - DNA, 500 bp, Homo sapiens
  misc_feature: HIJSMM301A3N5H.19.78.H01.1.454.light.4.raw
tactctcgtgcacgaccggtgctcgatttagtgtgagtagtttgggtttgggggctttatttgggctctgctgctcctcactctactcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtcactctcgttcccaccctcctccacgagagta

SEQ ID NO: 596778 - DNA, 503 bp, Homo sapiens; identical to SEQ ID NO: 576321
  misc_feature: HIJSMM301AJ5SZ.17.28.C06.1.454.light.4.raw

SEQ ID NO: 596779 - DNA, 495 bp, Homo sapiens
  misc_feature: HIJSMM301CMU0H.13.38.D05.1.454.light.4.raw
tcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggaggatcaaacgaact

SEQ ID NO: 596780 - DNA, 498 bp, Homo sapiens
  misc_feature: HIJSMM301B9VR8.40.63.F08.1.454.light.4.raw
tctagcgactcacgaccggtgctcgatttagcgatcgtataagggggcaggagtcagtctcagtcaggacacagcatggacatgagggtccccgctcagctcctggggctcctgctactctggctccgaggtgccacatgtgacatccagatgacccagtctccatcctccctgtctgcatccgtaggggacagagtcaccatcgcttgccgggcaagtcagcccatgaccaatcatttaagttggtatcagcagaaaccagggaaagcccctagactcctgatctatactgcgtccactttgcaaggtggggtcccccaaggttcagtggcagtggatctgagacagatttcagtcttactatcagcaatctgcaacctgaagattttgcgacttactactgcctacagacttacgacttcccgtggacgttcggccaagggaccaaggtggaaatcaaacgaactagtgctgcaccatctgtcttcatcttccccg

SEQ ID NO: 596781 - DNA, 489 bp, Homo sapiens
  misc_feature: HIJSMM301C9BKN.51.60.F05.1.454.light.4.raw
cgatcgtatacacgaccggtgctcgatttagtacgtcatcagggaaaggggatataaaatctgtgctgtcaaactgattaggaactgactaccacctgcaggtcagggccaaggttatggggtcccaggttcacctcctcagcttcctcctcctttggatctctgtcagatagcagggcagaaacgacactcacgcagtctccagcattcatgtcagcgactcgaggagacaaagtcaacatctcctgcaaagccagccaggacattgatgatgatatcaactggatccaacagaaaccaggagaggctggtattttcaatattcaagaacctactactctcgttcctggaatcccacctcgattcagtggcagcgggtatggaacagattttaccctcacaattaataacatagaatctgaggatgctgcatattacttctgtctacaacatgataatttcctcggcacttttggccaggggaccaag

SEQ ID NO: 596782 - DNA, 501 bp, Homo sapiens; identical to SEQ ID NO: 535746
  misc_feature: HIJSMM301DLGRF.18.11.A11.1.454.light.4.raw

SEQ ID NO: 596783 - DNA, 494 bp, Homo sapiens; identical to SEQ ID NO: 534992
  misc_feature: HIJSMM301BMY76.9.1.A01.1.454.light.4.raw

SEQ ID NO: 596784 - DNA, 502 bp, Homo sapiens
  misc_feature: HIJSMM301A2FY5.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctggtgttcggcggagggaccaaactgaccgtctaggtcagcccaaggctgccccctcggtcactctgtt

SEQ ID NO: 596785 - DNA, 496 bp, Homo sapiens
  misc_feature: HIJSMM301CHLIJ.52.38.D05.1.454.light.4.raw
cgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccccactgt

SEQ ID NO: 596786 - DNA, 509 bp, Homo sapiens; identical to SEQ ID NO: 547302
  misc_feature: HIJSMM301BK6LJ.4.57.F02.1.454.light.4.raw

SEQ ID NO: 596787 - DNA, 487 bp, Homo sapiens
  misc_feature: HIJSMM301DLFRS.49.73.G07.1.454.light.4.raw
agtcgagagacacgaccggtgctcgatttagctctacgctcagggcacgaccggtgctcgatttagtagtgtagattcgcgggggcaggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaatagggtccatcaaggttcagtggaagtggatctgggacgtatttactttcaccatcatcaacctgcagcctgaggatattgcaacatattactgtcaaacaatatgataatactaccactcactttcggcggagggaccaac

SEQ ID NO: 596788 - DNA, 496 bp, Homo sapiens; identical to SEQ ID NO: 574100
  misc_feature: HIJSMM301BJVME.47.64.F09.1.454.light.4.raw

SEQ ID NO: 596789 - DNA, 506 bp, Homo sapiens; identical to SEQ ID NO: 534969
  misc_feature: HIJSMM301BNVFD.18.37.D04.1.454.light.4.raw

SEQ ID NO: 596790 - DNA, 443 bp, Homo sapiens
  misc_feature: HIJSMM301CVK1K.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctgttcccgccctcctccgtgtctgt

SEQ ID NO: 596791 - DNA, 505 bp, Homo sapiens; identical to SEQ ID NO: 536254
  misc_feature: HIJSMM301BAJ08.7.71.G05.1.454.light.4.raw

SEQ ID NO: 596792 - DNA, 511 bp, Homo sapiens; identical to SEQ ID NO: 537464
  misc_feature: HIJSMM301AXLXA.7.34.D01.1.454.light.4.raw

SEQ ID NO: 596793 - DNA, 526 bp, Homo sapiens
  misc_feature: HIJSMM301AQJFF.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagatttgcagtatattactgtcagcaatatggtacttcaccccggacgtcggtccaacgggacgaacggtaggaagtacgaacgaactacgtaggcgtgcgaccactactgtacttctacttcttcccgtcccactctcgt

SEQ ID NO: 596794 - DNA, 524 bp, Homo sapiens
  misc_feature: HIJSMM301EX3Q4.10.38.D05.1.454.light.4.raw
catagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttggcggcgggactaaggtgaccgtccgtgggtcagcccaaggctcgccccctcggtccactctcgttccccgccctt

SEQ ID NO: 596795 - DNA, 469 bp, Homo sapiens
  misc_feature: HIJSMM301DALMX.49.30.C08.1.454.light.4.raw
agtcgagagacacgaccggtgctcgatttagtctgacgtcaaagggaaagggggagtcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtatgatcgtctcccgctcactttcggcgggggaccgaaggtggagatcaagcgaa

SEQ ID NO: 596796 - DNA, 484 bp, Homo sapiens; identical to SEQ ID NO: 535400
  misc_feature: HIJSMM301CDK1E.46.26.C04.1.454.light.4.raw

SEQ ID NO: 596797 - DNA, 489 bp, Homo sapiens; identical to SEQ ID NO: 569361
  misc_feature: HIJSMM301EGW10.3.55.E11.1.454.light.4.raw

SEQ ID NO: 596798 - DNA, 479 bp, Homo sapiens; identical to SEQ ID NO: 553293
  misc_feature: HIJSMM301A3FW2.9.76.G10.1.454.light.4.raw

SEQ ID NO: 596799 - DNA, 500 bp, Homo sapiens; identical to SEQ ID NO: 551915
  misc_feature: HIJSMM301CONN9.18.11.A11.1.454.light.4.raw

SEQ ID NO: 596800 - DNA, 443 bp, Homo sapiens
  misc_feature: HIJSMM301E1NVM.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccaccctcctcgacaccgag

SEQ ID NO: 596801 - DNA, 485 bp, Homo sapiens; identical to SEQ ID NO: 570096
  misc_feature: HIJSMM301A4IC0.46.35.D02.1.454.light.4.raw

SEQ ID NO: 596802 - DNA, 497 bp, Homo sapiens
  misc_feature: HIJSMM301C6IYV.8.10.A10.1.454.light.4.raw
ctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaagagccaccctctcctgcagggccagtcttagtgttagcaacttagcctggtaccaacagaaacctggccaggctcccaggctcctcatctctgatacatccaacagggccactggcatcccagccaggttcagtggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatcttcccgccat

SEQ ID NO: 596803 - DNA, 496 bp, Homo sapiens; identical to SEQ ID NO: 540207
  misc_feature: HIJSMM301B6BV8.40.57.F02.1.454.light.4.raw

SEQ ID NO: 596804 - DNA, 502 bp, Homo sapiens
  misc_feature: HIJSMM301CQJIN.21.38.D05.1.454.light.4.raw
tcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaagagttactctctcctgcaaggccagtcagagtgttggcatcgacgttgcctggtaccaacaaaaacctggccaggctcccagtctcctcatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtggctgcaccatctgtcttcatttcccg

SEQ ID NO: 596805 - DNA, 511 bp, Homo sapiens
  misc_feature: HIJSMM301EK6ON.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtgtgttcggcggagggaccaagctggccgtcctaggtcagcccaaggctgccccctggtcactctgtcccaccctcctcgagtagtaca

SEQ ID NO: 596806 - DNA, 484 bp, Homo sapiens; identical to SEQ ID NO: 558109
  misc_feature: HIJSMM301BUM1V.3.10.A10.1.454.light.4.raw

SEQ ID NO: 596807 - DNA, 497 bp, Homo sapiens
  misc_feature: HIJSMM301DKD47.10.79.H02.1.454.light.4.raw
catagtagtgcacgaccggtgctcgatttagtgtcacacgaagggaaagggggctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagatttgcagtgtattattgtcagcaatatggtaggtcacctgggacttttggtccaggggaccgaagacctggaggatcaaacgaactgtggctgcaccatctgtcttcat

SEQ ID NO: 596808 - DNA, 479 bp, Homo sapiens
  misc_feature: HIJSMM301B2BKH.52.10.A10.1.454.light.4.raw
cgcagtacgacacgaccggtgctcgatttagcgtcgatctcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaacccctgaactcctgatctatggttcatccactttgctgagtggggtcccatcaaggttcagtggcagtggatctgggacagaattcactctcaccatcaccagtctgcaggctgaggattttgcaacttacttctgtcaacagagttacagttccctcactttcgccctgggaccatagtggatatcaaacgaactgtggctgcaccatctgtctt

SEQ ID NO: 596809 - DNA, 444 bp, Homo sapiens; identical to SEQ ID NO: 535027
  misc_feature: HIJSMM301AE9W7.8.73.G07.1.454.light.4.raw

SEQ ID NO: 596810 - DNA, 506 bp, Homo sapiens
  misc_feature: HIJSMM301ERGL4.15.59.F04.1.454.light.4.raw
tctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtgctggcatttcggtcttcggcggagggaccaagctgaccgtcctaggtcagcccaaggctgccccctggt

SEQ ID NO: 596811 - DNA, 495 bp, Homo sapiens; identical to SEQ ID NO: 554164
  misc_feature: HIJSMM301AMYMY.27.78.H01.1.454.light.4.raw

SEQ ID NO: 596812 - DNA, 482 bp, Homo sapiens
  misc_feature: HIJSMM301BLPSD.10.73.G07.1.454.light.4.raw
catagtagtgcacgaccggtgctcgatttagctctacgctcagggggagtcagtctcagtcaggacacagcatggacatgagggtccccgctcagctcctggggctcctgctactctggctccgaggtgccagatgtgacatccaaatgacccagtctccatcctccctgtctgcatctttaggcgacagagtcaccattacttgccgggcaagtcagagcattaccaactctttaaattggtttcaacagaggccagggaaagcccctaagctcctggtctatggtgcatccactgtgcaaactggggtcccatccaggttcagtggcagtggatttgggacagatttcactctcaccatcaacaatctgcagcctgatgatttcgcaacttactactgtcaacagagttacacgacgccaatcactttcggccctgggaccaaagtggatatcaagcgaactgtggctgcaccatctgtt

SEQ ID NO: 596813 - DNA, 490 bp, Homo sapiens; identical to SEQ ID NO: 535234
  misc_feature: HIJSMM301A061N.17.21.B10.1.454.light.4.raw

SEQ ID NO: 596814 - DNA, 492 bp, Homo sapiens; identical to SEQ ID NO: 547144
  misc_feature: HIJSMM301EJIP9.16.53.E09.1.454.light.4.raw

SEQ ID NO: 596815 - DNA, 484 bp, Homo sapiens; identical to SEQ ID NO: 537086
  misc_feature: HIJSMM301B5WTE.5.39.D06.1.454.light.4.raw

SEQ ID NO: 596816 - DNA, 454 bp, Homo sapiens; identical to SEQ ID NO: 534964
  misc_feature: HIJSMM301BZ2Y3.19.86.H09.1.454.light.4.raw

SEQ ID NO: 596817 - DNA, 504 bp, Homo sapiens; identical to SEQ ID NO: 550837
  misc_feature: HIJSMM301CQ4WT.48.57.F02.1.454.light.4.raw

SEQ ID NO: 596818 - DNA, 508 bp, Homo sapiens
  misc_feature: HIJSMM301BZOHK.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtaggaaagtacaaacgaactagtggcgtgcaccatctgtcttcatcttccccg

SEQ ID NO: 596819 - DNA, 513 bp, Homo sapiens
  misc_feature: HIJSMM301AU2IG.18.26.C04.1.454.light.4.raw
tacgagtatgcacgaccggtgctcgatttagtctagcgactttgggtttgggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccgaaggtagagatacaaaggaactaggtggcgtgccgaccatctgttcttctatccttccccgccta

SEQ ID NO: 596820 - DNA, 494 bp, Homo sapiens; identical to SEQ ID NO: 534994
  misc_feature: HIJSMM301BPS6A.27.78.H01.1.454.light.4.raw

SEQ ID NO: 596821 - DNA, 515 bp, Homo sapiens; identical to SEQ ID NO: 592849
  misc_feature: HIJSMM301EO099.9.20.B09.1.454.light.4.raw

SEQ ID NO: 596822 - DNA, 492 bp, Homo sapiens
  misc_feature: HIJSMM301CROS0.4.24.C02.1.454.light.4.raw
agcactgtagcacgaccggtgctcgatttagtacagatcgttagggaaagggggagtcagactcagtcaggacacagcatggacatgagggtccccgctcagctcctggggctcctgctgctctggctcccaggtgccaaatgtgacgtccagatgacccagtctccttccaccctgtctgcatctataggagacagagtcaccatcacttgccgggccagtcagagtattagtaactggttggcctggtatcagcagaaaccaggcaaagccccaaaactccttatctctgatgcctccactttgcacggtggggtcccaccaacgttcagcggcagtgggtctgggacagaattcactctcaccatcagcagcctgcaacctgatgatgttgcaacttattactgtcaacaatataactagttattggacgttcggccaagggaccaaggtggaaatcagacgaactgtggctgcaccatctgtcttcta

SEQ ID NO: 596823 - DNA, 505 bp, Homo sapiens; identical to SEQ ID NO: 547383
  misc_feature: HIJSMM301BT2SL.3.79.H02.1.454.light.4.raw

SEQ ID NO: 596824 - DNA, 520 bp, Homo sapiens; identical to SEQ ID NO: 537173
  misc_feature: HIJSMM301A1AGY.27.23.C01.1.454.light.4.raw

SEQ ID NO: 596825 - DNA, 489 bp, Homo sapiens
  misc_feature: HIJSMM301C4OBB.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatccacttttggccaagggaccaagctggagatcaaacgaactgtggctgcaccta

SEQ ID NO: 596826 - DNA, 501 bp, Homo sapiens; identical to SEQ ID NO: 555551
  misc_feature: HIJSMM301C1B6W.21.81.H04.1.454.light.4.raw

SEQ ID NO: 596827 - DNA, 500 bp, Homo sapiens
  misc_feature: HIJSMM301EEYWU.7.5.A05.1.454.light.4.raw
cgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccgtaatcgcttctctggctccaagtctggcgacacggcctccctcgaccatctctgggctccaggctgaagacgaggctgattattactgcagctcatatacaggcagcagcactcaggttttcggcggagggaccaagctgaccgtcctaggtcagcccaaggctcgccccctcggt

SEQ ID NO: 596828 - DNA, 486 bp, Homo sapiens
  misc_feature: HIJSMM301CHCTQ.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcaggtgggtctgggacaggagttcactctcaccatcagcagcctgcagtctgaagtattttgctagtttattactgtcagcactataataactggcctccgtactagttttggccaggggaccaagctggagatacaaacgaa

SEQ ID NO: 596829 - DNA, 478 bp, Homo sapiens
  misc_feature: HIJSMM301ALBSH.12.1.A01.1.454.light.4.raw
atacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgcaacttattactgtcaacagagtaacagttaccctcccactttcggcggagggaccaaggtggagatcaaacgaactagtggctgca

SEQ ID NO: 596830 - DNA, 510 bp, Homo sapiens
  misc_feature: HIJSMM301BX655.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggattcggtacggacggtaggtaccgtaccgtacgtacggtacaccgaccgaacggaccccaacccacttcg

SEQ ID NO: 596831 - DNA, 520 bp, Homo sapiens; identical to SEQ ID NO: 539176
  misc_feature: HIJSMM301EQJTX.27.23.C01.1.454.light.4.raw

SEQ ID NO: 596832 - DNA, 506 bp, Homo sapiens; identical to SEQ ID NO: 538260
  misc_feature: HIJSMM301BU18D.7.71.G05.1.454.light.4.raw

SEQ ID NO: 596833 - DNA, 513 bp, Homo sapiens; identical to SEQ ID NO: 535244
  misc_feature: HIJSMM301EEVJB.17.33.C11.1.454.light.4.raw

SEQ ID NO: 596834 - DNA, 459 bp, Homo sapiens; identical to SEQ ID NO: 541801
  misc_feature: HIJSMM301ATS7S.22.28.C06.1.454.light.4.raw

SEQ ID NO: 596835 - DNA, 492 bp, Homo sapiens
  misc_feature: HIJSMM301CMATW.8.53.E09.1.454.light.4.raw
ctcgcgtgtccacgaccggtgctcgatttagagagagtgtgttgggtttgggggcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctaccg

SEQ ID NO: 596836 - DNA, 498 bp, Homo sapiens; identical to SEQ ID NO: 580475
  misc_feature: HIJSMM301COQP3.22.14.B03.1.454.light.4.raw

SEQ ID NO: 596837 - DNA, 509 bp, Homo sapiens; identical to SEQ ID NO: 539359
  misc_feature: HIJSMM301ADBPN.47.85.H08.1.454.light.4.raw

SEQ ID NO: 596838 - DNA, 495 bp, Homo sapiens; identical to SEQ ID NO: 535143
  misc_feature: HIJSMM301BXHVB.51.29.C07.1.454.light.4.raw

SEQ ID NO: 596839 - DNA, 487 bp, Homo sapiens; identical to SEQ ID NO: 545190
  misc_feature: HIJSMM301A5DH7.3.12.B01.1.454.light.4.raw

SEQ ID NO: 596840 - DNA, 513 bp, Homo sapiens; identical to SEQ ID NO: 543313
  misc_feature: HIJSMM301DDGVC.22.36.D03.1.454.light.4.raw

SEQ ID NO: 596841 - DNA, 484 bp, Homo sapiens; identical to SEQ ID NO: 535240
  misc_feature: HIJSMM301APDHV.47.60.F05.1.454.light.4.raw

SEQ ID NO: 596842 - DNA, 496 bp, Homo sapiens; identical to SEQ ID NO: 538149
  misc_feature: HIJSMM301AU0W3.13.67.G01.1.454.light.4.raw

SEQ ID NO: 596843 - DNA, 500 bp, Homo sapiens
  misc_feature: HIJSMM301ENGY2.10.43.D10.1.454.light.4.raw
catagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccacttcggccctgggaccaaagtggatatcaaacgaactgtggctgcaccatctgtcttcat

SEQ ID NO: 596844 - DNA, 488 bp, Homo sapiens; identical to SEQ ID NO: 536554
  misc_feature: HIJSMM301CBWHU.26.37.D04.1.454.light.4.raw

SEQ ID NO: 596845 - DNA, 497 bp, Homo sapiens; identical to SEQ ID NO: 536371
  misc_feature: HIJSMM301BH3SU.16.78.H01.1.454.light.4.raw

SEQ ID NO: 596846 - DNA, 494 bp, Homo sapiens; identical to SEQ ID NO: 534994
  misc_feature: HIJSMM301C8E29.27.78.H01.1.454.light.4.raw

SEQ ID NO: 596847 - DNA, 488 bp, Homo sapiens; identical to SEQ ID NO: 553834
  misc_feature: HIJSMM301EDPNZ.17.35.D02.1.454.light.4.raw

SEQ ID NO: 596848 - DNA, 486 bp, Homo sapiens; identical to SEQ ID NO: 542999
  misc_feature: HIJSMM301BM0SE.17.55.E11.1.454.light.4.raw

SEQ ID NO: 596849 - DNA, 508 bp, Homo sapiens
  misc_feature: HIJSMM301ARG1O.21.87.H10.1.454.light.4.raw
tcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaaactcttaatttctggcgtcaatcagcgaccctcacatgtttccagtcgattctctgcatccaagtctggcaacacggcctttctgacaatctctcaactccaggctgaagacgaggctattttattactgctcctcatacgcaggtggcacattttttcttggtttttggcggcgggacccagatgactgtcctcagtcagcccaaggctgccccctggt

SEQ ID NO: 596850 - DNA, 493 bp, Homo sapiens
  misc_feature: HIJSMM301CTO2T.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccagggacacgactggagattaaaggaactgtggctgcaccatctgtcttcatcttccccg

SEQ ID NO: 596851 - DNA, 512 bp, Homo sapiens
  misc_feature: HIJSMM301DNVPX.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcactactgtcgtttggtgttcggcggagggaccaagttgaccgtcctaggtcagcccaaggctgccccctcggtcactctgttccccg

SEQ ID NO: 596852 - DNA, 477 bp, Homo sapiens; identical to SEQ ID NO: 535122
  misc_feature: HIJSMM301BKAFG.26.72.G06.1.454.light.4.raw

SEQ ID NO: 596853 - DNA, 449 bp, Homo sapiens
  misc_feature: HIJSMM301BPTSL.18.9.A09.1.454.light.4.raw
tacgagtatgcacgaccggtgctcgatttagcgagacgcgcagggtcctggggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcacctgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccaccctcctccatactcgta

SEQ ID NO: 596854 - DNA, 505 bp, Homo sapiens
  misc_feature: HIJSMM301CSWDC.15.86.H09.1.454.light.4.raw
  modified_base (432)..(432): a, c, t, g, unknown or other
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttggtgttcggnggagggaccaaggctgaccgtcctaggtcagcccaaggctgccccctcggtcactctgttcccgccctcctcg

SEQ ID NO: 596855 - DNA, 479 bp, Homo sapiens; identical to SEQ ID NO: 535531
  misc_feature: HIJSMM301EV9OW.41.17.B06.1.454.light.4.raw

SEQ ID NO: 596856 - DNA, 496 bp, Homo sapiens
  misc_feature: HIJSMM301DUK0I.26.80.H03.1.454.light.4.raw
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagtttttaccctcacaactcatatcacagaatctgaggatgctgcattttacttcggtctacaacatgataatttccctccgtggacgttcgccaagggaccaaggagcaaatcaaacgaactgtggctgcaccatctgtcttcatcttcccgccat

SEQ ID NO: 596857 - DNA, 487 bp, Homo sapiens; identical to SEQ ID NO: 585180
  misc_feature: HIJSMM301BDMRN.19.71.G05.1.454.light.4.raw

SEQ ID NO: 596858 - DNA, 496 bp, Homo sapiens; identical to SEQ ID NO: 548177
  misc_feature: HIJSMM301D3W5X.18.59.F04.1.454.light.4.raw

SEQ ID NO: 596859 - DNA, 505 bp, Homo sapiens
  misc_feature: HIJSMM301DOW31.22.15.B04.1.454.light.4.raw
acatacgcgtcacgaccggtgctcgatttagacagtatatatccgcggggggggtcgtcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaggatgaggctgattattactgcagctcatatggaggcagcgacaatttggtgttcggcggagggaccaagctgaccgtcctaggtcagcccaaggctgccccctcggtcta

SEQ ID NO: 596860 - DNA, 490 bp, Homo sapiens
  misc_feature: HIJSMM301B0XVD.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgcccccccgatcaccttcggccaagggacacgactggagattaaacgaactgtgctgcaccatctgtcttcatt

SEQ ID NO: 596861 - DNA, 491 bp, Homo sapiens; identical to SEQ ID NO: 535294
  misc_feature: HIJSMM301A2IZC.16.68.G02.1.454.light.4.raw

SEQ ID NO: 596862 - DNA, 511 bp, Homo sapiens; identical to SEQ ID NO: 548439
  misc_feature: HIJSMM301BHGGT.16.46.E02.1.454.light.4.raw

SEQ ID NO: 596863 - DNA, 487 bp, Homo sapiens
  misc_feature: HIJSMM301BBW7L.14.53.E09.1.454.light.4.raw
cgtctagtaccacgaccggtgctcgatttagagagagtgtgttgggtttggggggggagcctagctgtgctgtgggtccaggaggcagaactctgggtgtctcaccatggcctggatccctctacttctcctcctcctcactctctgcacaggctctcaggcctcctatgagctgacacagccaccctcggtgtcagtgtcccccaggacagacggccaggatcacctgctctggagatttgttgacaaagcagtatgctttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcggtgttcggcggagggaccaagctgaccgtccta

SEQ ID NO: 596864 - DNA, 483 bp, Homo sapiens
  misc_feature: HIJSMM301AK7IS.41.68.G02.1.454.light.4.raw
tctatactatcacgaccggtgctcgatttagtcgatagtgaagggaaagggggagtcagtcccaaccaggacacagcatggacatgagggtccctgctcagctcctggggctcctgctgctctggctctcaggtgccagatgtgacatccagatgacccagtctccaacctccctgtctgcatctgtaggagacagagtcaccatcacttgccaggccagtcaggacattagcaactatttaaattggtatcagcagaaaccagggaaagcccctaagctcctgatctacgatgcatccaatttggaatcaggggtcccatcaaggttcagtggaagtggatctgggacagatttttactttcaccatcaccagcctgcagcctgaagatattgcaacatattactgtcaacagtatgataatctccctcccactttcggcggagggaccgaaggtggagatcaaacgaactgtggctgcacc

SEQ ID NO: 596865 - DNA, 503 bp, Homo sapiens
  misc_feature: HIJSMM301CD2W3.40.38.D05.1.454.light.4.raw
tctagcgactcacgaccggtgctcgatttagtatctgatagttgggtttggggcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggtcagagggtcaccatctcttgttctggaagcagatccaacatcggaagtaatactgtaaactggtaccagcagctcccaggaacggcccccaaactcctcatctatgataatagtcaccggccctcaggggtacctgaccgattctctggctccaagtctggcacctcagcctccctggccatcagtgggctccagtctgaggatgaggctgattatcactgtgcatcctgggatgacagcctgaatggttgggtggttcggcggggggaccgaaggctgaccgtcctaagtcagcccaac

SEQ ID NO: 596866 - DNA, 506 bp, Homo sapiens
  misc_feature: HIJSMM301CHG4A.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcaccagcctgcagtctgaagattttgcagtctattactgtcagcaatataattactggctctctttcggtccgggggaccggaacgactggaggagttcaaccgaaccgtagtggcgtcgcgaccactctcgttcc

SEQ ID NO: 596867 - DNA, 501 bp, Homo sapiens
  misc_feature: HIJSMM301AVWYS.11.21.B10.1.454.light.4.raw
cgagagataccacgaccggtgctcgatttagtgtcgtcgcaaggagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaacagaaacctggccagactcccaggctcctcatctatgatgcatccaacagggccactggcaccccagccaggttccagtggcagtgggtctgggacagacttcactctcaccatcagcagcctagagcctgaggattttgcagtttattactgtcagcagcgtatcgactggatcaccttcggccaagggacacgactggaaattaaacgaactgtggctgcaccatctgtcttcatcttccccg

SEQ ID NO: 596868 - DNA, 494 bp, Homo sapiens; identical to SEQ ID NO: 534994
  misc_feature: HIJSMM301EL4WU.27.78.H01.1.454.light.4.raw

SEQ ID NO: 596869 - DNA, 497 bp, Homo sapiens
  misc_feature: HIJSMM301DO11N.40.57.F02.1.454.light.4.raw
tctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgctgctcttatgcaggcagtttcgctctcgaagtgttcggcggagggaccgagctgaccgtcctacgtcagcccaaggctcc

SEQ ID NO: 596870 - DNA, 519 bp, Homo sapiens
  misc_feature: HIJSMM301C1Z0V.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcaggcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttcatcttccccg

SEQ ID NO: 596871 - DNA, 496 bp, Homo sapiens
  misc_feature: HIJSMM301BJSQ6.9.53.E09.1.454.light.4.raw
tgatacgtctcacgaccggtgctcgatttagagagagtgtgttggggtttggggggggtcacagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctaggtcagcccaaggct

SEQ ID NO: 596872 - DNA, 485 bp, Homo sapiens
  misc_feature: HIJSMM301CZEDV.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtacccgtacacttttggccagggaccaaactggacatcaaacgaactgtggctgcaccatctgtt

SEQ ID NO: 596873 - DNA, 485 bp, Homo sapiens; identical to SEQ ID NO: 535985
  misc_feature: HIJSMM301CNAR5.15.1.A01.1.454.light.4.raw

SEQ ID NO: 596874 - DNA, 503 bp, Homo sapiens
  misc_feature: HIJSMM301ADS48.14.35.D02.1.454.light.4.raw
cgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtaccaacagaaaccaggacagtctcctaagttgctcattttctgggcatctacccgggaatccggggtccctgagcgattcagtggcagcgggtctgggacagatttcactttcaccatcagcagcctgcaggctgaagatgtggcagtttattactgtcagcaatattatagtactccctacacttttggccaggggaccgaagctggagatcaaacgaactagtggctgcaccta

SEQ ID NO: 596875 - DNA, 501 bp, Homo sapiens; identical to SEQ ID NO: 542394
  misc_feature: HIJSMM301ES2KS.18.23.C01.1.454.light.4.raw

SEQ ID NO: 596876 - DNA, 500 bp, Homo sapiens
  misc_feature: HIJSMM301EQEN3.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtcttcatcttcccgccactgacatta

SEQ ID NO: 596877 - DNA, 484 bp, Homo sapiens; identical to SEQ ID NO: 535400
  misc_feature: HIJSMM301CTC17.46.26.C04.1.454.light.4.raw

SEQ ID NO: 596878 - DNA, 503 bp, Homo sapiens; identical to SEQ ID NO: 586457
  misc_feature: HIJSMM301CNJQV.7.71.G05.1.454.light.4.raw

SEQ ID NO: 596879 - DNA, 516 bp, Homo sapiens
  misc_feature: HIJSMM301BGUQP.22.36.D03.1.454.light.4.raw
acatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaacccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaattaggtcgccactctcgtggttttcggtcggaggcaccgaagtgaccgtcctcggtcagcccaaggctgccccctcggtccact

SEQ ID NO: 596880 - DNA, 501 bp, Homo sapiens; identical to SEQ ID NO: 536142
  misc_feature: HIJSMM301AYM9W.15.1.A01.1.454.light.4.raw

SEQ ID NO: 596881 - DNA, 509 bp, Homo sapiens; identical to SEQ ID NO: 535670
  misc_feature: HIJSMM301DCG9P.47.23.C01.1.454.light.4.raw

SEQ ID NO: 596882 - DNA, 494 bp, Homo sapiens
  misc_feature: HIJSMM301AVBHK.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccagggtggagatcaaacgaactagtggctgcaccatctgtcttcatt

SEQ ID NO: 596883 - DNA, 484 bp, Homo sapiens; identical to SEQ ID NO: 544700
  misc_feature: HIJSMM301EFDET.41.78.H01.1.454.light.4.raw

SEQ ID NO: 596884 - DNA, 509 bp, Homo sapiens
  misc_feature: HIJSMM301EWE6J.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaaattgagatacaaacgaaactgtggctgcaccatctgtcttcatcttcccgccact

SEQ ID NO: 596885 - DNA, 499 bp, Homo sapiens
  misc_feature: HIJSMM301BHXT6.53.38.D05.1.454.light.4.raw
cgcgtatacacacgaccggtgctcgatttagtatctgatagttgggtttgggggtgggtccaggaggcagaactctgggtgtctcaccatggcctggatccctctacttctccccctcctcactctgtgcacaggctctgaggcctcctatgaggtgacacagccaccctcggtgtcagtgtccccaggacagacggccaggatcacctgctctggagaggcattggcaaaacaatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactattactgtcaatctgcggacagcagtggttctcatgtggtattcggcggagggaccaagctgaccgtcctaggtcagcccaaggctgccccctcggtcact

SEQ ID NO: 596886 - DNA, 514 bp, Homo sapiens; identical to SEQ ID NO: 550589
  misc_feature: HIJSMM301C4V6F.16.66.F11.1.454.light.4.raw

SEQ ID NO: 596887 - DNA, 493 bp, Homo sapiens
  misc_feature: HIJSMM301EPEYT.5.48.E04.1.454.light.4.raw
atcagacacgcacgaccggtgctcgatttagagagcgtcacagagagaaggggaggacccagagggaaccatggaaaccccagcgcagcttctcttcctcctgctactctggctcccagattctgccggagaagttgtcttgacgcagtctccaggcaccctgtctttgtctccaggtgaaagcgccaccctctcctgccgggccagtgagagtcttagcggcgactacttagcctggtatcagcaaaaacctggccagtctcccaggctcctcatctctggtgtttccttcagggccactggcgtcccaggcagattcaggggcagtgggtctgggacagacttcactctcaccatcagcagactggagcctgaagactttgcgctgtatttctgtcagcagtatgttttcgcacctttcacttttcggcggagggaccaaggtggagagcagacgaactgtggctgcaccatctgtcttcatcttcccgcc

SEQ ID NO: 596888 - DNA, 486 bp, Homo sapiens; identical to SEQ ID NO: 538200
  misc_feature: HIJSMM301A1PF2.21.55.E11.1.454.light.4.raw

SEQ ID NO: 596889 - DNA, 507 bp, Homo sapiens; identical to SEQ ID NO: 536874
  misc_feature: HIJSMM301AK76T.17.41.D08.1.454.light.4.raw

SEQ ID NO: 596890 - DNA, 473 bp, Homo sapiens; identical to SEQ ID NO: 553582
  misc_feature: HIJSMM301ET36L.53.85.H08.1.454.light.4.raw

SEQ ID NO: 596891 - DNA, 504 bp, Homo sapiens
  misc_feature: HIJSMM301BNZZ4.14.3.A03.1.454.light.4.raw
cgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaagcccccaaactcattatttatgaggtcaataatcggccctcaggagtttctaatcgcttctctggctccaagtctggcaacacggcctcctgagcatctctgggctccaggctgaggacgaggctgattattactgcagctcatatactattagcagaactgtggttttcggcggagggaccaaggtgaccgtcctaggtcagcccaaggctgccccctcggtcactctcg

SEQ ID NO: 596892 - DNA, 518 bp, Homo sapiens; identical to SEQ ID NO: 539372
  misc_feature: HIJSMM301EFAUV.7.86.H09.1.454.light.4.raw

SEQ ID NO: 596893 - DNA, 513 bp, Homo sapiens; identical to SEQ ID NO: 542179
  misc_feature: HIJSMM301A7X5K.17.33.C11.1.454.light.4.raw

SEQ ID NO: 596894 - DNA, 506 bp, Homo sapiens
  misc_feature: HIJSMM301B9494.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctggtcagcccaaggctgccccctcggtctacc

SEQ ID NO: 596895 - DNA, 511 bp, Homo sapiens
  misc_feature: HIJSMM301DUGNO.5.58.F03.1.454.light.4.raw
atcagacacgcacgaccggtgctcgatttagtctgatcgagaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggatgggaccaaggtcaccgtcctaggtcagcccaaggccaacccactgtcactctcg

SEQ ID NO: 596896 - DNA, 512 bp, Homo sapiens
  misc_feature: HIJSMM301D1NG8.48.56.F01.1.454.light.4.raw
agtatacatacacgaccggtgctcgatttagcagacgtctgaacacacaaagggggtggtagctcaggaagcagagcctggagcatctccactatggcctggactccactacttctcaccctcctcgctcactgcacaggttcttgggccacttttaaactgactcagccccactccgtgtcggggtctccggggaagacggtaagcatcacctgcacccgcaccagtggcgacattgccagcaactttgtgcagtgggtccagcagcgcccgggccgttcccccgccactgtaatatatgaggacattcaaagaccttctggggtccctcctcgattctctggctccatcgacaggtcctccaactccgcctccctcttcatctctgaactgaagactgaggacgaggctgcttattactgtcagtcctctgatggcagcgcagttgtcttcgggcggagggaccacactgaccgttatcggtcagcccaaggcctgccccctcggtcact

SEQ ID NO: 596897 - DNA, 493 bp, Homo sapiens; identical to SEQ ID NO: 571339
  misc_feature: HIJSMM301DSZHW.10.72.G06.1.454.light.4.raw

SEQ ID NO: 596898 - DNA, 492 bp, Homo sapiens; identical to SEQ ID NO: 536733
  misc_feature: HIJSMM301CCKYZ.40.11.A11.1.454.light.4.raw

SEQ ID NO: 596899 - DNA, 499 bp, Homo sapiens
  misc_feature: HIJSMM301C0J36.48.87.H10.1.454.light.4.raw
agtatacatacacgaccggtgctcgatttagcagtactgcgttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctccg

SEQ ID NO: 596900 - DNA, 488 bp, Homo sapiens; identical to SEQ ID NO: 538811
  misc_feature: HIJSMM301ASJC0.40.83.H06.1.454.light.4.raw

SEQ ID NO: 596901 - DNA, 454 bp, Homo sapiens; identical to SEQ ID NO: 535005
  misc_feature: HIJSMM301BO4AE.19.86.H09.1.454.light.4.raw

SEQ ID NO: 596902 - DNA, 505 bp, Homo sapiens
  misc_feature: HIJSMM301A4746.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaactccactgtcactt

SEQ ID NO: 596903 - DNA, 465 bp, Homo sapiens
  misc_feature: HIJSMM301DZ9NX.13.4.A04.1.454.light.4.raw
tcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagattttactttcaccatcagcagcctgcagcctgaagatattgcaacatattactgtcagcagtatgataatctccgatcaccttcggccaagggcaacgactggagattaaacgaa

SEQ ID NO: 596904 - DNA, 506 bp, Homo sapiens
  misc_feature: HIJSMM301AWXUT.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaaggaccaaggtggaagtcagcgaactgtggctgcaccatctgtcttcatcttcccgcc

SEQ ID NO: 596905 - DNA, 494 bp, Homo sapiens; identical to SEQ ID NO: 592127
  misc_feature: HIJSMM301DHKSV.40.11.A11.1.454.light.4.raw

SEQ ID NO: 596906 - DNA, 494 bp, Homo sapiens; identical to SEQ ID NO: 534994
  misc_feature: HIJSMM301B1C7G.27.78.H01.1.454.light.4.raw

SEQ ID NO: 596907 - DNA, 519 bp, Homo sapiens
  misc_feature: HIJSMM301DIML5.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtctaggtcagcccaaggctgccccctcggtcactctgttccaccct

SEQ ID NO: 596908 - DNA, 489 bp, Homo sapiens; identical to SEQ ID NO: 535139
  misc_feature: HIJSMM301CWBGP.14.55.E11.1.454.light.4.raw

SEQ ID NO: 596909 - DNA, 487 bp, Homo sapiens
  misc_feature: HIJSMM301DZACY.5.28.C06.1.454.light.4.raw
atcagacacgcacgaccggtgctcgatttagagctcacgtattgggtttgggggtcagtcccaaccaggacacagcatggacatgagggtccctgctcagctcctggggctcctgctgctctggctctcaggtgccagatgtgacatccagatgacccagtctccatcgtccgtgtctgcatctgtaggagacagagtcaccatcacttgtcaggcgagtcaggacattggtaattacttaacttggtatcagcagaaaccagggaaagtccccaaactcctgatctacgatgcatctaatttggaaataggggtctcatcaaggttcagtgggagtggatctgggacagaattcactttcaccatcagcagcctgcaacctgaagatattgcaacatattactgtcaacagtatgatagtctggccgccttcggtcggagggaccgaacggtggaggatcgaacgaacctagtggcgtgcacctaa

SEQ ID NO: 596910 - DNA, 513 bp, Homo sapiens; identical to SEQ ID NO: 546362
  misc_feature: HIJSMM301EB1BZ.16.66.F11.1.454.light.4.raw

SEQ ID NO: 596911 - DNA, 494 bp, Homo sapiens
  misc_feature: HIJSMM301DIJX3.27.78.H01.1.454.light.4.raw
  modified_base (458)..(458): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgacnggagattaaacgaactgtggctgcaccatctgtctt

SEQ ID NO: 596912 - DNA, 509 bp, Homo sapiens; identical to SEQ ID NO: 542213
  misc_feature: HIJSMM301E2AM3.17.41.D08.1.454.light.4.raw

SEQ ID NO: 596913 - DNA, 486 bp, Homo sapiens; identical to SEQ ID NO: 535043
  misc_feature: HIJSMM301E1XY0.46.35.D02.1.454.light.4.raw

SEQ ID NO: 596914 - DNA, 503 bp, Homo sapiens
  misc_feature: HIJSMM301ERQ38.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggcagcccaaggctgccccctggtcactctgttcccaccctcctcg

SEQ ID NO: 596915 - DNA, 495 bp, Homo sapiens; identical to SEQ ID NO: 535596
  misc_feature: HIJSMM301A63RQ.10.79.H02.1.454.light.4.raw

SEQ ID NO: 596916 - DNA, 499 bp, Homo sapiens; identical to SEQ ID NO: 537739
  misc_feature: HIJSMM301DJ7M6.12.86.H09.1.454.light.4.raw

SEQ ID NO: 596917 - DNA, 503 bp, Homo sapiens
  misc_feature: HIJSMM301COAYI.43.38.D05.1.454.light.4.raw
tgtgagtagtcacgaccggtgctcgatttagtatctgatagttgggtttgggggagtcagacccagtcaggacacagcctggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagactattattacctggttggcctggtatcagcagaaaccagggaaagcccctaaactcctgatctttgaggcatctcgtttagaaagtggggtcccctcaaggttcagcggcagtgcatctgggacagatttcactctcaccatcagcagcctgcagcctgatgattttgcaacttattactgtcaacagtataatagttacccctggacgttcggccaaggaccagggtggaaatcaaacgaactagtggctgcaccatcttgtcttcatcttccccg

SEQ ID NO: 596918 - DNA, 479 bp, Homo sapiens
  misc_feature: HIJSMM301D0HC4.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatctatgttgcatccactttgcaaagtggggtcccatcaaggttcagcggcagtggatctgggacagaattcactctcacaatcagcagcctgcagcctgaagattttgcaacttattactgtcaacagcttaatagttacccgctcagtttcggcggagggaccaaggtggagatcaaacgaactgtgg

SEQ ID NO: 596919 - DNA, 504 bp, Homo sapiens; identical to SEQ ID NO: 535561
  misc_feature: HIJSMM301AOD1I.4.57.F02.1.454.light.4.raw

SEQ ID NO: 596920 - DNA, 487 bp, Homo sapiens; identical to SEQ ID NO: 545190
  misc_feature: HIJSMM301AYBIO.3.12.B01.1.454.light.4.raw

SEQ ID NO: 596921 - DNA, 516 bp, Homo sapiens
  misc_feature: HIJSMM301CSUUA.40.74.G08.1.454.light.4.raw
tctagcgactcacgaccggtgctcgatttagtagctctatcagggggggggaagctcagcttcagctgtgggtagagaagacaggactcaggacaatctccagcatggccagcttccctctcctcctcaccctcctcactcactgtgcagggtcctgggcccagtctgtcctgactcagccaccctcagcgtctgggacccccgggcagacggtgaccatctcctgttctggaagcagttccaacatcggaagtaataatgtgaattggtaccggcaactcccaggaacggcccccaaactcctcatacatagtaatgatcatcggccccctggggtccctgaccgaatctctggctccaggtctggcgcctcagcctccctggtcattagtgggctccagtctgacgatgaggctgactattactgttcagcgtgggatgccagcccgaatcattgggtgttcggcggagggaccaaactgaccgtcctaggtcagccaaggctgccccctcggt

SEQ ID NO: 596922 - DNA, 496 bp, Homo sapiens; identical to SEQ ID NO: 535541
  misc_feature: HIJSMM301A75UQ.3.33.C11.1.454.light.4.raw

SEQ ID NO: 596923 - DNA, 492 bp, Homo sapiens; identical to SEQ ID NO: 535126
  misc_feature: HIJSMM301BLBH2.18.11.A11.1.454.light.4.raw

SEQ ID NO: 596924 - DNA, 496 bp, Homo sapiens; identical to SEQ ID NO: 560353
  misc_feature: HIJSMM301AZ6IE.43.16.B05.1.454.light.4.raw

SEQ ID NO: 596925 - DNA, 498 bp, Homo sapiens
  misc_feature: HIJSMM301D2MWB.40.37.D04.1.454.light.4.raw
tctagcgactcacgaccggtgctcgatttagtagcatactgttgggtttgggggatcaggacttctcagttcatcttctcaccatgaggctccctgctcagctcctggggctgctaatgctctggatccctggttccagtgcgagggttgtgatgactcagactccactctctctgtccgtcacccctggacagccggcctccatctcctacaagtctgctcagagcctcctgcatggtgatggaatcacctatttatattggtacctgcagaagccaggccagtctccacagctcctaatctatgaggtttccagccggttctctggagtgccagataggttcagtggcagcgggtcagtgacagatttcacactgaaaatcagccgggtggaggctgaggatgttggggtttattactgcatgcaaggtttataccttcctcggtactttcggtcccgtcgggaccgacgagtggtagtgttcgaaacgaactagt

SEQ ID NO: 596926 - DNA, 513 bp, Homo sapiens; identical to SEQ ID NO: 563195
  misc_feature: HIJSMM301EBWW9.43.23.C01.1.454.light.4.raw

SEQ ID NO: 596927 - DNA, 521 bp, Homo sapiens; identical to SEQ ID NO: 539470
  misc_feature: HIJSMM301AULZL.27.23.C01.1.454.light.4.raw

SEQ ID NO: 596928 - DNA, 506 bp, Homo sapiens
  misc_feature: HIJSMM301BZ7DY.43.15.B04.1.454.light.4.raw
tgtgagtagtcacgaccggtgctcgatttagacagtatatatccgcggggaggaactgctcagttaggacccagacggaaccatggaagccccagcgcagcttctcttcctcctgctactctggctcccagaaaccactggagaaatagtgatgacgcagtctccagccaccctgtctttgtctccaggggaaagagccaccctctcatgcagggccagtcagagtgttagcaccaacgtggcctggtaccagcagaaacctggccagcctccccggctcctcatctctggtgcatcctccagggccactggttccccagccaggttcagtggcagtgggtctgggacagagttcactctcaccatcagcagccttcagtctgaagattttgcagtttattactgtcaccagtatcataactggcctccaagggggactttcggccaagggaccaaggtggaattcaaccgaactagtggctgcaccatctgtcttcatcttcccg

SEQ ID NO: 596929 - DNA, 483 bp, Homo sapiens
  misc_feature: HIJSMM301EA93S.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggcccttgggaccaatgtggatatcaaacgaactgtggctgcaccatctgtt

SEQ ID NO: 596930 - DNA, 504 bp, Homo sapiens
  misc_feature: HIJSMM301BWC9R.43.37.D04.1.454.light.4.raw
tgtgagtagtcacgaccggtgctcgatttagtagcatactgttgggtttgggggtgggtagagaagacaggactcaggacaatctccagcatggccagcttccctctcctcctcaccctcctcactcactgtgcagggtcctgggcccagtctgtggtgactcagccaccctcagcgtctgggacccccggacagagggtcagcatctcctgttctggaagcagctccaacattggacgtaatactgtaaactggtaccagcaactcgcaggaacggcccccaaactcctcatctatgaccatcatcagcggccctcaggggtccctgaccgattctctggctccaagtctggctcttcagcctccctggccatcagtgggctccagtctgaggatgaggctgattattactgtgcagcgtgggatgacagcctgaatgcttgggtgttcggcggagggaccaagggtgaccgtcctaggtcagcccaaggctgccccctcggt

SEQ ID NO: 596931 - DNA, 489 bp, Homo sapiens
  misc_feature: HIJSMM301CDEXH.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggttattactgcatgcaagctctacaaactccttacacttttggccaggggaccaagctggaggatcaaacgaact

SEQ ID NO: 596932 - DNA, 463 bp, Homo sapiens; identical to SEQ ID NO: 535008
  misc_feature: HIJSMM301BHH4G.10.9.A09.1.454.light.4.raw

SEQ ID NO: 596933 - DNA, 513 bp, Homo sapiens; identical to SEQ ID NO: 565259
  misc_feature: HIJSMM301DPW0X.17.33.C11.1.454.light.4.raw

SEQ ID NO: 596934 - DNA, 494 bp, Homo sapiens; identical to SEQ ID NO: 540767
  misc_feature: HIJSMM301A1YM2.11.81.H04.1.454.light.4.raw

SEQ ID NO: 596935 - DNA, 502 bp, Homo sapiens
  misc_feature: HIJSMM301D6R4N.14.86.H09.1.454.light.4.raw
cgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaagagccaccctctcctgcagggccagtcagagtgttagcacctccttagcctggtaccaacagaaacctggccaggctcccagcctcctcatctctgatgcttccaacagggccactggcatcccagccaggttcagtggcagtgggtctgggacagacttcactctcaccatcagctccctagagcctggagattttgtagtttattactgtcagcagtatagcagctggcctcccactttcggcggagggaccaaggtggagatccaacgactgtggctgcaccatctgtcttcatctccccg

SEQ ID NO: 596936 - DNA, 485 bp, Homo sapiens; identical to SEQ ID NO: 545782
  misc_feature: HIJSMM301A3HZ1.17.21.B10.1.454.light.4.raw

SEQ ID NO: 596937 - DNA, 507 bp, Homo sapiens; identical to SEQ ID NO: 564521
  misc_feature: HIJSMM301DH21I.21.87.H10.1.454.light.4.raw

SEQ ID NO: 596938 - DNA, 507 bp, Homo sapiens
  misc_feature: HIJSMM301C8Z2H.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggcaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccggggccactttcggccctgggaccaaggtggagatcaaacgaactgtggctgcaccactctgtcttcta

SEQ ID NO: 596939 - DNA, 446 bp, Homo sapiens
  misc_feature: HIJSMM301AO7EY.18.9.A09.1.454.light.4.raw
tacgagtatgcacgaccggtgctcgatttagcgagacgcgcagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccccactgtcactctcgttccccacccctcctccatactccta

SEQ ID NO: 596940 - DNA, 485 bp, Homo sapiens; identical to SEQ ID NO: 536576
  misc_feature: HIJSMM301AUWJO.46.35.D02.1.454.light.4.raw

SEQ ID NO: 596941 - DNA, 497 bp, Homo sapiens; identical to SEQ ID NO: 536371
  misc_feature: HIJSMM301DA9ZL.16.78.H01.1.454.light.4.raw

SEQ ID NO: 596942 - DNA, 487 bp, Homo sapiens
  misc_feature: HIJSMM301EUQZQ.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtgggtcccatcaaggttcagcggcagtgggtctgggacagaattcactctcaccatcagcagcctgcaacctgatgactttgcaacttattactgccaacagtataatggttatgaatccacttttgggcaagggaccaagctggagatcaaacgaactgtggctgcacc

SEQ ID NO: 596943 - DNA, 479 bp, Homo sapiens; identical to SEQ ID NO: 538734
  misc_feature: HIJSMM301DJ4DC.8.53.E09.1.454.light.4.raw

SEQ ID NO: 596944 - DNA, 520 bp, Homo sapiens; identical to SEQ ID NO: 592903
  misc_feature: HIJSMM301CT0Q1.9.38.D05.1.454.light.4.raw

SEQ ID NO: 596945 - DNA, 518 bp, Homo sapiens
  misc_feature: HIJSMM301ASQS6.14.66.F11.1.454.light.4.raw
cgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctcggaagctattatgcaagctggtaccagcagaagccaggacaggcccctgtacttgtcatctatggtaaaaacatccggccctcagggatcccagaccgattctctggctccaactcaggaaacacagcttccttgaccatcactggggctcaggcggaagatgaggctgactattactgtaattcccgggacagcagtgctaacccccaattatgtcttcggaactgggaccaaggtcaccgtcctaggtcagcccaaggccaacccca

SEQ ID NO: 596946 - DNA, 486 bp, Homo sapiens; identical to SEQ ID NO: 535043
  misc_feature: HIJSMM301ATDWG.46.35.D02.1.454.light.4.raw

SEQ ID NO: 596947 - DNA, 505 bp, Homo sapiens; identical to SEQ ID NO: 536117
  misc_feature: HIJSMM301BW4MF.8.71.G05.1.454.light.4.raw

SEQ ID NO: 596948 - DNA, 487 bp, Homo sapiens; identical to SEQ ID NO: 539157
  misc_feature: HIJSMM301EK98I.26.37.D04.1.454.light.4.raw

SEQ ID NO: 596949 - DNA, 506 bp, Homo sapiens; identical to SEQ ID NO: 554189
  misc_feature: HIJSMM301B4F7U.19.78.H01.1.454.light.4.raw

SEQ ID NO: 596950 - DNA, 500 bp, Homo sapiens
  misc_feature: HIJSMM301CZM14.43.58.F03.1.454.light.4.raw
tgtgagtagtcacgaccggtgctcgatttagtctgatcgagaagggaaagggggagagactgaagaacccagcattgcagcagctccaccatggcctgggctcctctgctcctcaccctcctcagtctcctcacagggtccctctcccagcctgtgctgactcagccaccttctgcatcagcctccctgggagcctcggtcacactcacctgcaccctaaccagcggctacgtggactgctttcagcagagaccaggggagggccccccgtttgtgatgcgagtgggcactggtgggattgtgggatccaagggggatggcatccctgaccgcttctcagtcttgggctcaggcctgaatcggcacctgaccatcaagaacatccaggaagagggtgagagtgactcccactgtggggcagaccatggcagtgggagcaacttccgtgagggtgttcggcggagggaccaggctgaccgtctacgtcagcccaaggctcg

SEQ ID NO: 596951 - DNA, 487 bp, Homo sapiens; identical to SEQ ID NO: 536179
  misc_feature: HIJSMM301DG4RE.19.57.F02.1.454.light.4.raw

SEQ ID NO: 596952 - DNA, 505 bp, Homo sapiens; identical to SEQ ID NO: 574237
  misc_feature: HIJSMM301D91MK.19.78.H01.1.454.light.4.raw

SEQ ID NO: 596953 - DNA, 502 bp, Homo sapiens; identical to SEQ ID NO: 539314
  misc_feature: HIJSMM301B27EV.21.81.H04.1.454.light.4.raw

SEQ ID NO: 596954 - DNA, 506 bp, Homo sapiens
  misc_feature: HIJSMM301D3J4O.53.62.F07.1.454.light.4.raw
cgcgtatacacacgaccggtgctcgatttagtagtcgcataaagggaaagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaagaaaatatgcttattggtaccaacagaggtcaggccaggcccctgtgctggtcatctatgaggacaccaaacgaccctccgggatccctgcgagattctctggcgccagctcagggacagtggccaccctgacagtcagtgggcccaggtggaggatgaagctgattactactgttactcaacagacaggagtggaaatcatagggtattcgggcggagggaccaagctgaccgtcctaggtcagcccaaggctgccccctcggtcacttccg

SEQ ID NO: 596955 - DNA, 486 bp, Homo sapiens
  misc_feature: HIJSMM301DME5N.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacactttggccaggggaccaagctggagatcaaacgaa

SEQ ID NO: 596956 - DNA, 500 bp, Homo sapiens; identical to SEQ ID NO: 536183
  misc_feature: HIJSMM301DX9K6.10.17.B06.1.454.light.4.raw

SEQ ID NO: 596957 - DNA, 513 bp, Homo sapiens; identical to SEQ ID NO: 535244
  misc_feature: HIJSMM301AOU8D.17.33.C11.1.454.light.4.raw

SEQ ID NO: 596958 - DNA, 499 bp, Homo sapiens; identical to SEQ ID NO: 571905
  misc_feature: HIJSMM301CZTAB.43.34.D01.1.454.light.4.raw

SEQ ID NO: 596959 - DNA, 492 bp, Homo sapiens; identical to SEQ ID NO: 580589
  misc_feature: HIJSMM301AZ31O.14.36.D03.1.454.light.4.raw

SEQ ID NO: 596960 - DNA, 486 bp, Homo sapiens; identical to SEQ ID NO: 535043
  misc_feature: HIJSMM301BI0HX.46.35.D02.1.454.light.4.raw

SEQ ID NO: 596961 - DNA, 499 bp, Homo sapiens
  misc_feature: HIJSMM301B8UX2.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagccctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaagggaccaaggtggaaatcaaacgaactgtggctgcacc

SEQ ID NO: 596962 - DNA, 493 bp, Homo sapiens; identical to SEQ ID NO: 578344
  misc_feature: HIJSMM301D013G.27.78.H01.1.454.light.4.raw

SEQ ID NO: 596963 - DNA, 506 bp, Homo sapiens; identical to SEQ ID NO: 534969
  misc_feature: HIJSMM301EP0Z1.18.37.D04.1.454.light.4.raw

SEQ ID NO: 596964 - DNA, 486 bp, Homo sapiens; identical to SEQ ID NO: 535043
  misc_feature: HIJSMM301B8RYW.46.35.D02.1.454.light.4.raw

SEQ ID NO: 596965 - DNA, 498 bp, Homo sapiens
  misc_feature: HIJSMM301C3RN6.41.53.E09.1.454.light.4.raw
tctatactatcacgaccggtgctcgatttagagagagtgtgttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctggggacgaggctgattattactgcagctcatatacaagcagcagcactctcgtggtattcggcggagggaccaagctgaccgtcctaggtcagcccaaggctg

SEQ ID NO: 596966 - DNA, 504 bp, Homo sapiens; identical to SEQ ID NO: 551974
  misc_feature: HIJSMM301DZNBF.19.78.H01.1.454.light.4.raw

SEQ ID NO: 596967 - DNA, 491 bp, Homo sapiens
  misc_feature: HIJSMM301CR5EU.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggccaggggaccaaaactggatatcagacgaactgtggctgca

SEQ ID NO: 596968 - DNA, 502 bp, Homo sapiens; identical to SEQ ID NO: 575571
  misc_feature: HIJSMM301CTWP4.12.67.G01.1.454.light.4.raw

SEQ ID NO: 596969 - DNA, 484 bp, Homo sapiens; identical to SEQ ID NO: 538247
  misc_feature: HIJSMM301A9C58.14.53.E09.1.454.light.4.raw

SEQ ID NO: 596970 - DNA, 488 bp, Homo sapiens; identical to SEQ ID NO: 536742
  misc_feature: HIJSMM301D5FJR.3.72.G06.1.454.light.4.raw

SEQ ID NO: 596971 - DNA, 501 bp, Homo sapiens; identical to SEQ ID NO: 536142
  misc_feature: HIJSMM301EM7YB.15.1.A01.1.454.light.4.raw

SEQ ID NO: 596972 - DNA, 501 bp, Homo sapiens; identical to SEQ ID NO: 535746
  misc_feature: HIJSMM301C6IKR.18.11.A11.1.454.light.4.raw

SEQ ID NO: 596973 - DNA, 485 bp, Homo sapiens
  misc_feature: HIJSMM301DV8BF.4.27.C05.1.454.light.4.raw
agcactgtagcacgaccggtgctcgatttagacgcgatcgaagggtttgggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcgtcctacatagtaatggatacaactatttggattggtacctgcagaagccagggcagtctccacagctcctgatctatttgggttctaaccgggcctccggggtccctgacaggttcagtggcagtggatcaggcacagattttacactgagaatcagcagagtggaggctgaggatgttggggttactactgcatgcaagctctacaagccacctacacttttggccaggggacccaggctggagatcaaacggaact

SEQ ID NO: 596974 - DNA, 486 bp, Homo sapiens; identical to SEQ ID NO: 535385
  misc_feature: HIJSMM301CBNNF.19.71.G05.1.454.light.4.raw

SEQ ID NO: 596975 - DNA, 491 bp, Homo sapiens; identical to SEQ ID NO: 535294
  misc_feature: HIJSMM301DKBQN.16.68.G02.1.454.light.4.raw

SEQ ID NO: 596976 - DNA, 505 bp, Homo sapiens; identical to SEQ ID NO: 535503
  misc_feature: HIJSMM301AUTZG.8.28.C06.1.454.light.4.raw

SEQ ID NO: 596977 - DNA, 486 bp, Homo sapiens; identical to SEQ ID NO: 535290
  misc_feature: HIJSMM301BA638.3.12.B01.1.454.light.4.raw

SEQ ID NO: 596978 - DNA, 502 bp, Homo sapiens
  misc_feature: HIJSMM301CZSPN.48.25.C03.1.454.light.4.raw
agtatacatacacgaccggtgctcgatttagtagtgtagatttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcacatctgtcttcatcttcccg

SEQ ID NO: 596979 - DNA, 501 bp, Homo sapiens
  misc_feature: HIJSMM301CUGGW.40.57.F02.1.454.light.4.raw
tctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttatttttgtctgctcttatgtcaggcagtttcgctctcgaagtgttcggcggagggaccgagctgaccgtcctacgtcagcccaaggctccg

SEQ ID NO: 596980 - DNA, 500 bp, Homo sapiens
  misc_feature: HIJSMM301DHQIU.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggtccgaagggaccaaggtggataagtcagacgaactgtggcgtg

SEQ ID NO: 596981 - DNA, 521 bp, Homo sapiens; identical to SEQ ID NO: 538715
  misc_feature: HIJSMM301AUO1G.27.23.C01.1.454.light.4.raw

SEQ ID NO: 596982 - DNA, 495 bp, Homo sapiens
  misc_feature: HIJSMM301D2SPY.8.10.A10.1.454.light.4.raw
ctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaagagccaccctctcctgcagggccagtcttagtgttagcaacttagcctggtaccaacagaaacctggccaggctcccaggctcctcatctctgatacatccaacagggccactggcatcccagccaggttcagtggcagtgggtctgggacagacttcactctcaccatcagcagcctagagcctgaagattttgcactttattactgtcagcagcgtagtaactggcctttcactttcggccctgggaccaaagtggatatcaaacgaactgtggctgcacatctgtctcatcttcccgccat

SEQ ID NO: 596983 - DNA, 490 bp, Homo sapiens
  misc_feature: HIJSMM301C4K8N.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattacttgcatgcaagctctacaaactccttacacttttggccaggggaccaagctggagatcaaacgaact

SEQ ID NO: 596984 - DNA, 490 bp, Homo sapiens
  misc_feature: HIJSMM301CH4WS.48.41.D08.1.454.light.4.raw
agtatacatacacgaccggtgctcgatttagtcacgcgagaaagggaaagggggaagagctgctcagttaggacccagagggaaccatggaaaccccagcgcagcttctcttcctcctgctactctggctcccagatagcaccggagaaatcgtgttgacgcagtctccaggcaccctgtctgtgtctccaggggaaagagccaccctctcctgcagggccagtcagagtgttagcagcagctacttagcctggtaccagcagaaaccgggccaggctcccaggctcctcatctatggtgcatccagcagggccactggcatcccagacaggttcagttgcagtgggtctgggacagacttcactctcaccatcagcagactggagcctgaagattttgcaatttattactgtcagcagtatggtacctcacccaggtacacttttggccaggggaccaagctggagatcaaacgaactgtggctgcacc

SEQ ID NO: 596985 - DNA, 513 bp, Homo sapiens; identical to SEQ ID NO: 535244
  misc_feature: HIJSMM301B12LW.17.33.C11.1.454.light.4.raw

SEQ ID NO: 596986 - DNA, 475 bp, Homo sapiens
  misc_feature: HIJSMM301B0MHX.4.14.B03.1.454.light.4.raw
agcactgtagcacgaccggtgctcgatttagtgtgagtagttccgcgggggcaggagtcagactcagtcaggacacagcatggacatgagggtccccgctcagctcctggggctcctgctgctctggctcccaggtgccagatgtgacatccaaatgacccagtctccttccaccctgtctgcatctgtgggagacagagtcactatcacttgccgggccagtcagagcattagtggctggctggcctggtatcagcagaaaccagggagagcccctaagctcttgatctttgatgccaccaatttggaaagtgggtcccatcaagattcagcggcagtggatttgggacagaattcactctcaccatcagcagcctgcagcctggtgattttgcaacttattactgccaacagtataatagttattctctcactttcggtcggagggaccaaggtggaggatcaaacgaactgt

SEQ ID NO: 596987 - DNA, 480 bp, Homo sapiens; identical to SEQ ID NO: 535291
  misc_feature: HIJSMM301DS8GZ.22.59.F04.1.454.light.4.raw

SEQ ID NO: 596988 - DNA, 490 bp, Homo sapiens
  misc_feature: HIJSMM301A6B5Z.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtgggggctgaggatgttggctatttattactgcatgcaggctatacaccttcctgccacttttggccaggggaccaagctggagatcaggcgtaacg

SEQ ID NO: 596989 - DNA, 505 bp, Homo sapiens; identical to SEQ ID NO: 539433
  misc_feature: HIJSMM301BS72E.2.35.D02.1.454.light.4.raw

SEQ ID NO: 596990 - DNA, 495 bp, Homo sapiens
  misc_feature: HIJSMM301A3AMW.48.10.A10.1.454.light.4.raw
agtatacatacacgaccggtgctcgatttagcgtcgatctcagggggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggtccgaagggaccgacgggtaggaaagtacaaacgaaacctagtggctgcaccatctgtcttt

SEQ ID NO: 596991 - DNA, 489 bp, Homo sapiens
  misc_feature: HIJSMM301DJU37.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcaacaatattataataatccatttaatttcggcggagggaccaaggtggagatcaaacgaactgtggctgcaccatctgtcttcatcttcccgc

SEQ ID NO: 596992 - DNA, 441 bp, Homo sapiens; identical to SEQ ID NO: 546257
  misc_feature: HIJSMM301BK9V9.41.9.A09.1.454.light.4.raw

SEQ ID NO: 596993 - DNA, 487 bp, Homo sapiens
  misc_feature: HIJSMM301EIH3X.4.33.C11.1.454.light.4.raw
  modified_base (462)..(462): a, c, t, g, unknown or other
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggctagtttattactgtcagcaatattctactactcctccggactttcgcggnggaccgaaggtggagatacaacgaa

SEQ ID NO: 596994 - DNA, 495 bp, Homo sapiens
  misc_feature: HIJSMM301BHM70.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggaccacatttcaccctcaccatcaatagcctggaagctgaagatgctgcaacttattactgtcatcagagtactactttacctcaagtgatcaccttcggccaagggacacgactggagattaaacgaactgtggctgcaccatctgtctt

SEQ ID NO: 596995 - DNA, 521 bp, Homo sapiens
  misc_feature: HIJSMM301D33C1.48.38.D05.1.454.light.4.raw
agtatacatacacgaccggtgctcgatttagtatctgatagttgggtttggggagagaagacaggattcaggacaatctccagcatggccggcttccctctcctcctcaccctcctcactcactgtgcagggtcctgggcccagtctgtgttgactcagccaccctcaacgtctgggactcccgggcagaccgtcaccatctcttgttctggcagcagatggaacatcgggagcaattttgttcactggtaccagcaactgccaggagcggcccccaaactcctcatctacaggaatgataagcgaccctcaggggtccctgcccgattctctggctccaagtctggcaccacagcctccctggccatcagaggactccggtccgaggatgagggtgatttttattgtgctgtttgggatgacgacatgaatggttcgattttcggcggtagggaccaaactgaccgtcctgggtcagcccaaggctgccccctcggtcactctcgtcccaccctcctcta

SEQ ID NO: 596996 - DNA, 492 bp, Homo sapiens; identical to SEQ ID NO: 550823
  misc_feature: HIJSMM301C8B68.49.20.B09.1.454.light.4.raw

SEQ ID NO: 596997 - DNA, 489 bp, Homo sapiens; identical to SEQ ID NO: 541346
  misc_feature: HIJSMM301CF4ZZ.13.87.H10.1.454.light.4.raw

SEQ ID NO: 596998 - DNA, 501 bp, Homo sapiens
  misc_feature: HIJSMM301DU78U.51.2.A02.1.454.light.4.raw
cgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattacctgtgggggaaacaacattggaagtaaaactgtgcactggtaccagcagaagccaggccaggcccctgtgctggtcgtctatgatgatgccgaccggccctcagggatccctgaacgattctctggctccagctctgagaacacggccaccctgagcatcagcagggtcgaagccgggatgaggccgactattactgtcaggtgtgggatactagtagtgatcatgtcttcggacctgggaccaaggtcaccgtcctaggtcagcccaaggccaacccactgtcactctgttcccacct

SEQ ID NO: 596999 - DNA, 494 bp, Homo sapiens
  misc_feature: HIJSMM301EB0VL.43.33.C11.1.454.light.4.raw
  modified_base (302)..(302): a, c, t, g, unknown or other
tgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgntccgttgcacgttggggtcccacctcggttcagtggcaacggctctgagacagatttttctctcgtcatcactggtctacagtctgacgacggcgcaatgtacttctgtcaacactatgcctctcccccctacaatttcggtcaggggaccaagttgaacatcaatcgaactgtggctgcaccatctgtctt

SEQ ID NO: 597000 - DNA, 506 bp, Homo sapiens
  misc_feature: HIJSMM301CDS49.12.73.G07.1.454.light.4.raw
atacgacgtacacgaccggtgctcgatttagctctacgctcaggggctgggcccaaggaagcagcactggtggtgcctcagccatggcctggaccgttctcctcctcggcctcctctctcactgcacagcctctgtgacctcctatgtactgattcagtcgccctcggtgtcagtggccccaggacagacggccacgattacctgtggaggagacaatattgtcaccaaaagtgttcactggtaccagcagaagccaggccaggcccctgtggtggtcgtctatgatgatagcgaccggccctcggggatccctgagcgattctctggctccaactctgggaacatggccaccctgaccatccgcagggtcgaggccggggatgaggccgactattattgtcaggtgtgggataatggcagtgatcatgtcttattcggcggagggaccacgctgaccgtcctaagtcagcccaaggctgccccctcggtcactctgttcccacct

SEQ ID NO: 597001 - DNA, 491 bp, Homo sapiens
  misc_feature: HIJSMM301EZUCU.51.71.G05.1.454.light.4.raw
cgatcgtatacacgaccggtgctcgatttagtgtcgtcgcaagagagaggggggctgtgggtccaggaggcagaactctgggtgtctcaccatggcctggatcccctctacttcctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctggtcagcccaaggccaaccca

SEQ ID NO: 597002 - DNA, 486 bp, Homo sapiens; identical to SEQ ID NO: 536329
  misc_feature: HIJSMM301C0KD1.21.4.A04.1.454.light.4.raw

SEQ ID NO: 597003 - DNA, 502 bp, Homo sapiens
  misc_feature: HIJSMM301CZ0ZG.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagatttgcgtacttactattgtcaacagagttaccttctccccggacgtcgtcacggacgaaggaggaagtacaagacgactagtggcgtgcaccatctgtcttctatcttcccgt

SEQ ID NO: 597004 - DNA, 498 bp, Homo sapiens; identical to SEQ ID NO: 553247
  misc_feature: HIJSMM301EJV8Q.40.57.F02.1.454.light.4.raw

SEQ ID NO: 597005 - DNA, 487 bp, Homo sapiens
  misc_feature: HIJSMM301CRGR4.19.71.G05.1.454.light.4.raw
tactctcgtgcacgaccggtgctcgatttagtgtcgtcgcaagagagagggggacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaactgtgg

SEQ ID NO: 597006 - DNA, 494 bp, Homo sapiens
  misc_feature: HIJSMM301C38GF.51.29.C07.1.454.light.4.raw
cgatcgtatacacgaccggtgctcgatttagagtgctacgaagggaaagggggaggaactgctcagtcaggacccagacggaaccatggaagccccagcgcagcttctcttcctcctgctactctggctcccagatactactggagaaatagtgatgacgcagtctccagccacgctgtctgtgtctccaggggaaagagccaccctctcctgcagggccagtcagagtgttaacaacaacttagcctggtatcagcagaaacctggccaggctcccaggctcctcatctttggatcatccatcagggccactggtgtcccagaaaagttcagtggcggtgggtctgacacagagtacaccctcaccatcagcaccctgcagtctgaagatgtcgcagtttattactgtcaacaatatagtgacaggccgccatggacgttcggccaagggaccaaggtggaaatgaaaggaactgtggctgcaccatctgctt

SEQ ID NO: 597007 - DNA, 486 bp, Homo sapiens
  misc_feature: HIJSMM301BGYPU.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcttacacttttggccaggggaccaagctggagatcaaacgaa

SEQ ID NO: 597008 - DNA, 484 bp, Homo sapiens; identical to SEQ ID NO: 539003
  misc_feature: HIJSMM301B8TWE.10.1.A01.1.454.light.4.raw

SEQ ID NO: 597009 - DNA, 454 bp, Homo sapiens
  misc_feature: HIJSMM301EYOGY.18.78.H01.1.454.light.4.raw
tacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaagaccaaccccactgtcactctgttcccgccctcctccatactcgta

SEQ ID NO: 597010 - DNA, 489 bp, Homo sapiens; identical to SEQ ID NO: 536663
  misc_feature: HIJSMM301ET62E.16.72.G06.1.454.light.4.raw

SEQ ID NO: 597011 - DNA, 492 bp, Homo sapiens
  misc_feature: HIJSMM301D7FAU.17.86.H09.1.454.light.4.raw
cgtagactagcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactgtaaccagcagtgaccttagtgcttataactatgtctcctggtaccaacagcacccaggcaaggtccccaaagccatgatttatgaggtcagtaatcggccctcaggggtttctaatcgcttctctggctccaagtctggcaacacggcctccctcaccatctctggactccagcctgaggacgaggctgattattactgcatctcatttgtaagcagtagccttgtgttattcggcggagggaccaagctgaccgtcctggtcagcccaaggct

SEQ ID NO: 597012 - DNA, 514 bp, Homo sapiens; identical to SEQ ID NO: 539520
  misc_feature: HIJSMM301CS568.17.33.C11.1.454.light.4.raw

SEQ ID NO: 597013 - DNA, 513 bp, Homo sapiens; identical to SEQ ID NO: 592652
  misc_feature: HIJSMM301ALHOL.47.85.H08.1.454.light.4.raw

SEQ ID NO: 597014 - DNA, 496 bp, Homo sapiens; identical to SEQ ID NO: 535541
  misc_feature: HIJSMM301CF9E9.3.33.C11.1.454.light.4.raw

SEQ ID NO: 597015 - DNA, 506 bp, Homo sapiens; identical to SEQ ID NO: 548581
  misc_feature: HIJSMM301EQ50M.11.75.G09.1.454.light.4.raw

SEQ ID NO: 597016 - DNA, 496 bp, Homo sapiens; identical to SEQ ID NO: 541235
  misc_feature: HIJSMM301CBF25.3.31.C09.1.454.light.4.raw

SEQ ID NO: 597017 - DNA, 507 bp, Homo sapiens
  misc_feature: HIJSMM301AHV5Q.13.11.A11.1.454.light.4.raw
tcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgtttgacttggcacaacaacgcctggatcttcggacctgggaccacggtcaccgtcctaggtcagcccaaggcccaaccccactgtcactctgttccccg

SEQ ID NO: 597018 - DNA, 505 bp, Homo sapiens; identical to SEQ ID NO: 535987
  misc_feature: HIJSMM301ANUZ4.18.37.D04.1.454.light.4.raw

SEQ ID NO: 597019 - DNA, 489 bp, Homo sapiens; identical to SEQ ID NO: 562293
  misc_feature: HIJSMM301AM5TF.3.10.A10.1.454.light.4.raw

SEQ ID NO: 597020 - DNA, 505 bp, Homo sapiens; identical to SEQ ID NO: 555429
  misc_feature: HIJSMM301CDTJH.4.71.G05.1.454.light.4.raw

SEQ ID NO: 597021 - DNA, 447 bp, Homo sapiens; identical to SEQ ID NO: 535020
  misc_feature: HIJSMM301CHPRY.18.9.A09.1.454.light.4.raw

SEQ ID NO: 597022 - DNA, 497 bp, Homo sapiens; identical to SEQ ID NO: 583075
  misc_feature: HIJSMM301A7OAH.16.12.B01.1.454.light.4.raw

SEQ ID NO: 597023 - DNA, 486 bp, Homo sapiens
  misc_feature: HIJSMM301E1EZJ.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggatttgcaacttactactgtcagcaggctaacaggctcgcccccaaccttcggccaggggacacgactggagattaaacgaactgtggctgcaccatctgtt

SEQ ID NO: 597024 - DNA, 485 bp, Homo sapiens; identical to SEQ ID NO: 543441
  misc_feature: HIJSMM301AX0SE.26.55.E11.1.454.light.4.raw

SEQ ID NO: 597025 - DNA, 493 bp, Homo sapiens; identical to SEQ ID NO: 535047
  misc_feature: HIJSMM301ADW5W.16.53.E09.1.454.light.4.raw

SEQ ID NO: 597026 - DNA, 383 bp, Homo sapiens; identical to SEQ ID NO: 447524
  misc_feature: HIJSMM301CFKDK.41.26.C04.1.454.light.4.raw

SEQ ID NO: 597027 - DNA, 481 bp, Homo sapiens; identical to SEQ ID NO: 535993
  misc_feature: HIJSMM301BHZSE.21.25.C03.1.454.light.4.raw

SEQ ID NO: 597028 - DNA, 496 bp, Homo sapiens
  misc_feature: HIJSMM301B8I0L.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgacctggagattaaaggaactagtggctgcaccatctgtcttcatcttccccg

SEQ ID NO: 597029 - DNA, 502 bp, Homo sapiens; identical to SEQ ID NO: 539314
  misc_feature: HIJSMM301CQHD7.21.81.H04.1.454.light.4.raw

SEQ ID NO: 597030 - DNA, 490 bp, Homo sapiens; identical to SEQ ID NO: 535526
  misc_feature: HIJSMM301DUPI9.26.78.H01.1.454.light.4.raw

SEQ ID NO: 597031 - DNA, 493 bp, Homo sapiens
  misc_feature: HIJSMM301DJMFG.10.59.F04.1.454.light.4.raw
catagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgttggtggttatgactttgtctcctggtaccaacagcagccaggcgaagcccccaaattcatgatttatgatgtcagtgcgcggccctcgggggtccctgatcgcttctctggctccaagtctggcaacacggcctccctgaccatctctggcctccagcctgaggatgaggctgattattactgttgctcatatgcaggcggtaccgcgttgggtgttcggcggagggaccaaggctgaccgtcctacggtcagaccccg

SEQ ID NO: 597032 - DNA, 505 bp, Homo sapiens; identical to SEQ ID NO: 536254
  misc_feature: HIJSMM301DR068.7.71.G05.1.454.light.4.raw

SEQ ID NO: 597033 - DNA, 444 bp, Homo sapiens; identical to SEQ ID NO: 534993
  misc_feature: HIJSMM301A6380.5.9.A09.1.454.light.4.raw

SEQ ID NO: 597034 - DNA, 482 bp, Homo sapiens; identical to SEQ ID NO: 535920
  misc_feature: HIJSMM301CLS6W.19.71.G05.1.454.light.4.raw

SEQ ID NO: 597035 - DNA, 504 bp, Homo sapiens; identical to SEQ ID NO: 568334
  misc_feature: HIJSMM301EBZRH.12.48.E04.1.454.light.4.raw

SEQ ID NO: 597036 - DNA, 503 bp, Homo sapiens
  misc_feature: HIJSMM301A1CIL.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagccaaggccaactccactgtcact

SEQ ID NO: 597037 - DNA, 499 bp, Homo sapiens
  misc_feature: HIJSMM301BSL6D.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaacccc

SEQ ID NO: 597038 - DNA, 486 bp, Homo sapiens; identical to SEQ ID NO: 537310
  misc_feature: HIJSMM301DFRBG.15.28.C06.1.454.light.4.raw

SEQ ID NO: 597039 - DNA, 501 bp, Homo sapiens
  misc_feature: HIJSMM301EXDI2.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcatcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagcccaaggctgcccctcggt

SEQ ID NO: 597040 - DNA, 505 bp, Homo sapiens; identical to SEQ ID NO: 546412
  misc_feature: HIJSMM301CLW7M.22.21.B10.1.454.light.4.raw

SEQ ID NO: 597041 - DNA, 509 bp, Homo sapiens
  misc_feature: HIJSMM301A3W1E.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggcccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccactttcggccctggaccaaagtggatatcaaacgaactagtggctgcaccatctgtcttcta

SEQ ID NO: 597042 - DNA, 487 bp, Homo sapiens; identical to SEQ ID NO: 537208
  misc_feature: HIJSMM301C7IXU.3.55.E11.1.454.light.4.raw

SEQ ID NO: 597043 - DNA, 509 bp, Homo sapiens; identical to SEQ ID NO: 553073
  misc_feature: HIJSMM301A5BBM.16.1.A01.1.454.light.4.raw

SEQ ID NO: 597044 - DNA, 505 bp, Homo sapiens
  misc_feature: HIJSMM301ATQLT.22.15.B04.1.454.light.4.raw
acatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaggatgaggctgattattactgctgctcatttgcaggcgcctacacttgggtgttcggcggagggaccaagctgaccgtcctaggtcagcccaaggctgccccctcggtcact

SEQ ID NO: 597045 - DNA, 500 bp, Homo sapiens
  misc_feature: HIJSMM301AX0SI.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcacatctgtctt

SEQ ID NO: 597046 - DNA, 522 bp, Homo sapiens; identical to SEQ ID NO: 541090
  misc_feature: HIJSMM301D92V4.27.23.C01.1.454.light.4.raw

SEQ ID NO: 597047 - DNA, 493 bp, Homo sapiens; identical to SEQ ID NO: 535745
  misc_feature: HIJSMM301DX9J0.47.78.H01.1.454.light.4.raw

SEQ ID NO: 597048 - DNA, 491 bp, Homo sapiens
  misc_feature: HIJSMM301DK9RM.49.12.B01.1.454.light.4.raw
agtcgagagacacgaccggtgctcgatttagtagtgtagattccgcggggagctctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttcccaggaacggcccccagactcctcattcatgacaataacaagcgagtcccagagattcctgaccgattctctggctccaagtctggcacctcagccaccctggccatcaccggactccagactggggacgaggccgattattactgcggaacatgggattccagcctgagtggtgtcagggtgttcggcggagggaccaagctgaccgtcct

SEQ ID NO: 597049 - DNA, 491 bp, Homo sapiens; identical to SEQ ID NO: 538021
  misc_feature: HIJSMM301AQ6Z5.3.72.G06.1.454.light.4.raw

SEQ ID NO: 597050 - DNA, 494 bp, Homo sapiens; identical to SEQ ID NO: 536974
  misc_feature: HIJSMM301CEZTI.16.86.H09.1.454.light.4.raw

SEQ ID NO: 597051 - DNA, 503 bp, Homo sapiens
  misc_feature: HIJSMM301AUQGH.43.34.D01.1.454.light.4.raw
tgtgagtagtcacgaccggtgctcgatttagatcgtctgtgttgggtttggggggggtcgacaagaggcagcgctctcgggacggtctccaccatggcctgggctctgctgctcctcactctcctcgctcaggacacagggtccgtgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtaggttacacttatgtcttcggattgggacgacggtcaccgtcctaggtcagcccaaggccaacccca

SEQ ID NO: 597052 - DNA, 492 bp, Homo sapiens
  misc_feature: HIJSMM301AUHBW.14.36.D03.1.454.light.4.raw
cgtctagtaccacgaccggtgctcgatttagctgcgtcacgatctctcttgggggggtctcaggaggcagctctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaactcatgatttatgaggtcagtaatcggccctcaggggtttctaatcgcttctctggctccaagtctggcaacacggcctccctgaccatctctgggctccaggctgaggacgagtctgattattattgcagctcatatgcacctggcagcaatcatgtggttttcggtcggggggaccaaggtggaccgtcctaggtcagccc

SEQ ID NO: 597053 - DNA, 472 bp, Homo sapiens; identical to SEQ ID NO: 536302
  misc_feature: HIJSMM301DLTJ4.18.76.G10.1.454.light.4.raw

SEQ ID NO: 597054 - DNA, 513 bp, Homo sapiens
  misc_feature: HIJSMM301DVGLE.17.2.A02.1.454.light.4.raw
cgtagactagcacgaccggtgctcgatttagactcatctacagggggggtagagaagacaggactcaggacaatctccagcatggccagcttccctttcctcctcaccctcctcactcactgtgcagggtcctgggcccagtctgtactgactcagccaccctcagcgtctgggacccccggacagagggtcaccatctcttgttctggaagcagctccaacatcgggactaatactgtaacctggttccagcacgtcccaggaacggcccccaaactcgtcatgtataattatagtcagcggccctcaggggtccctgaccgattcgctggctccaactctggcacctcagcctccctggccatcagtgggctccagtctgaggatgaggctgattattactgtgcagcatgggatgccagcctgagtagtcccgtcttcggaactgggaccaaggtcaccgtcctacgtcagcccaaggccaaccccactgtcactctgttcccacctcct

SEQ ID NO: 597055 - DNA, 485 bp, Homo sapiens
  misc_feature: HIJSMM301D6893.17.39.D06.1.454.light.4.raw
cgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaaacctggccaggctcccaggctcctcatgtatggtgcatctaccagggccactggtgtcccagccaggttcagtggcagtgggtctgggacagagttctctctcatcatcagcagcctgcagtctgaagattttgcggtttattactgtcagcagtataatcagtggcctccgtggacgttcggccaagggaccaaggtggaaatacaaacgaactgtgg

SEQ ID NO: 597056 - DNA, 485 bp, Homo sapiens
  misc_feature: HIJSMM301ELW1W.19.71.G05.1.454.light.4.raw
tactctcgtgcacgaccggtgctcgatttagtgtcgtcgcaagagagagggggaggtacaacaggcaggcaaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggcaagggaccaaggtggatatcagacgaa

SEQ ID NO: 597057 - DNA, 493 bp, Homo sapiens
  misc_feature: HIJSMM301DZGAB.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccaggggaccaagctggagatcaaacgactagtgg

SEQ ID NO: 597058 - DNA, 499 bp, Homo sapiens
  misc_feature: HIJSMM301CXM9D.40.41.D08.1.454.light.4.raw
tctagcgactcacgaccggtgctcgatttagtcacgcgagaaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactccccatgtggtattcggcggagggaccaagctgaccgtcctaggtcagcccaaggctg

SEQ ID NO: 597059 - DNA, 492 bp, Homo sapiens
  misc_feature: HIJSMM301APCK8.40.11.A11.1.454.light.4.raw
tctagcgactcacgaccggtgctcgatttagctacgactgcaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtgtttttcacaccgccatgaacaaggagtacttggcttggttccagcagaaagcagggcagccccctaagctgctcatttactcggcatccacccggaaatccggagttcctgaccgattccgtggcagcgggtctgggacagattttactctcaccatcagtagcctgcagactgaagatgtggcagtttattactgtcaacaatattttcatactccgccgacgttcggccggggaccaacgtggaaatacaaacgaactgtggctgcaccatctgtcttcatcttcccgccat

SEQ ID NO: 597060 - DNA, 502 bp, Homo sapiens
  misc_feature: HIJSMM301COCD1.43.34.D01.1.454.light.4.raw
tgtgagtagtcacgaccggtgctcgatttagatcgtctgtgttgggtttgggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaaggccaacccccta

SEQ ID NO: 597061 - DNA, 483 bp, Homo sapiens
  misc_feature: HIJSMM301CV0OP.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaatttattactgtcagcagcgtagcaactggcctctcactttcggcggagggaccgagggtggagatcagacgaactgtggctgca

SEQ ID NO: 597062 - DNA, 498 bp, Homo sapiens
  misc_feature: HIJSMM301D3AEU.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcagcccaaggc

SEQ ID NO: 597063 - DNA, 508 bp, Homo sapiens; identical to SEQ ID NO: 552440
  misc_feature: HIJSMM301D9AZJ.5.24.C02.1.454.light.4.raw

SEQ ID NO: 597064 - DNA, 503 bp, Homo sapiens; identical to SEQ ID NO: 584187
  misc_feature: HIJSMM301ASLH9.21.81.H04.1.454.light.4.raw

SEQ ID NO: 597065 - DNA, 519 bp, Homo sapiens
  misc_feature: HIJSMM301DVQV0.40.34.D01.1.454.light.4.raw
tctagcgactcacgaccggtgctcgatttagatcgtctgtgttgggtttggggtgttgggtttgggaacctatgaacattctgtaggggccactgtcttctccactacttctcaccctcctcgctcactgcacaggttcttgggccaattttatgctgactcagccccactctgtgtcggggtctccggggaagacggtaaccatctcctgcacccgcagtagtggcagcattgccagcaactatgtgcagtggtaccagcagcgcccgggcagttcccccaccactttaatctatgaggataacaaaagactctctggggtccctgatcggttctctggctccatcgacagctcctccaattctgcctccctcaccatctctggactgaagactgaggacgaggctgattattactgtcagagttatgatgacaccaattactgggtgttcggcggagggaccaagctgaccgtcctaggtcagcccaaggctgccccctcggtcactctcgttcccg

SEQ ID NO: 597066 - DNA, 354 bp, Homo sapiens; identical to SEQ ID NO: 540485
  misc_feature: HIJSMM301BUGDK.40.9.A09.1.454.light.4.raw

SEQ ID NO: 597067 - DNA, 499 bp, Homo sapiens; identical to SEQ ID NO: 551769
  misc_feature: HIJSMM301D3VUH.43.34.D01.1.454.light.4.raw

SEQ ID NO: 597068 - DNA, 496 bp, Homo sapiens; identical to SEQ ID NO: 535109
  misc_feature: HIJSMM301C13IY.16.78.H01.1.454.light.4.raw

SEQ ID NO: 597069 - DNA, 467 bp, Homo sapiens
  misc_feature: HIJSMM301DFE2J.11.70.G04.1.454.light.4.raw
cgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtccatctcgattcagtggcagtggatctgggacagatttcactctcaccatcagcagcctgcagcctgaagatgttgcaacttattactgtcaaaagaatagcgctgccccgctcagtttcggcggagggaccaaggtggagataacg

SEQ ID NO: 597070 - DNA, 513 bp, Homo sapiens
  misc_feature: HIJSMM301CIWLL.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctcctccttggggcaaagctgccctgacactgtctggtgtgcagcctgaggacgaggctgactattactgcctactctactttggtggtgctgtgctattcggcggagggaccaagctgaccgtcttaagtcagcccaaggcctgccccctcggtcactctgttcccaccctcct

SEQ ID NO: 597071 - DNA, 528 bp, Homo sapiens
  misc_feature: HIJSMM301AK1DX.3.87.H10.1.454.light.4.raw
agacgcactccacgaccggtgctcgatttagcagtactgcgttgggtttggggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttgtctcctggtcctggtaccaaaaacacccaggcaaagcccccagattaatcgatttatgatgtcagtgatcggccctcaggggtttctcgatcgctttctggctccaagtctggcaacacggcctccctgaccatctctgggctccaggctgacggacgaggctgattatttctgtctagctcatacacaaccggcaccactgtcgtggttttcggtggagggtaccaagctgaccgtcctaggtcagcccaagggctgccccctcggtccacctccg

SEQ ID NO: 597072 - DNA, 444 bp, Homo sapiens; identical to SEQ ID NO: 537971
  misc_feature: HIJSMM301AKGPA.2.76.G10.1.454.light.4.raw

SEQ ID NO: 597073 - DNA, 491 bp, Homo sapiens
  misc_feature: HIJSMM301CXUWA.41.21.B10.1.454.light.4.raw
tctatactatcacgaccggtgctcgatttagtgtcgtcgcaagggggagccctggggaggaactgctcagttaggacccagagggaaccatggaagccccagctcagcttctcttcctcctgctactctggctcccagataccaccggacaaattgtgttgacacagtctccagccaccctgtctttgtctccaggggaaagagccaccctctcctgcagggccagtcagagtgttagcaaccacttagcctggtaccaacagagacctggccagactcccagactcgtcatctatgatgcatccaagagggccactggcatcccagccaggttcagtggcagtgggtctgggacagacttcactctcaccatcagcagcctagagcctgaagattttgcagtttattactgtcagcagcgtggcgactggcctcgcatcaccttcggccaagggacacgactggagactagacgaactgtggctgcacca

SEQ ID NO: 597074 - DNA, 503 bp, Homo sapiens
  misc_feature: HIJSMM301DBZCX.49.52.E08.1.454.light.4.raw
agtcgagagacacgaccggtgctcgatttagtcgagctctctcggcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagcggccctcaggggtctctgatcgcttctctggctccacgtctggcagcacggcctccctgacaatctctgggctccaggctggggacgaggctgattattattgctgttcatatgccggtgatagtggccgaagggtgttcggcggagggaccaaggtgaccgtcctaggtcagccaaggctcgccccctggt

SEQ ID NO: 597075 - DNA, 494 bp, Homo sapiens
  misc_feature: HIJSMM301EYIFB.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatatttcgtgctccgtacacttttggccagggacccaggtggagatcagacgaactgtggctgcaccatctgtcttctatcttcccg

SEQ ID NO: 597076 - DNA, 505 bp, Homo sapiens; identical to SEQ ID NO: 535987
  misc_feature: HIJSMM301D5KA0.18.37.D04.1.454.light.4.raw

SEQ ID NO: 597077 - DNA, 484 bp, Homo sapiens; identical to SEQ ID NO: 535400
  misc_feature: HIJSMM301ENKEU.46.26.C04.1.454.light.4.raw

SEQ ID NO: 597078 - DNA, 496 bp, Homo sapiens; identical to SEQ ID NO: 535541
  misc_feature: HIJSMM301D47BX.3.33.C11.1.454.light.4.raw

SEQ ID NO: 597079 - DNA, 495 bp, Homo sapiens
  misc_feature: HIJSMM301B8XTX.52.36.D03.1.454.light.4.raw
cgcagtacgacacgaccggtgctcgatttagctgcgtcacgatctctcttggggtgtgggctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtactgggaaaattatgctgactggtaccagcagaagccaggccaagcccctgagttggtgatatacgaaaatagtgagcgctaccctgggatccctgaccgattctctgggtccacctcaggaagacgaccaccctgaccatcaacaggtccggactgaagacgaggctgactatactgcttgtctggggatgaggacacattggtgttcggcggagggaccaagctgaccgtcctacgtcagcccaaggctgccccctcggtcactctccg

SEQ ID NO: 597080 - DNA, 514 bp, Homo sapiens
  misc_feature: HIJSMM301EZYOR.17.33.C11.1.454.light.4.raw
cgtagactagcacgaccggtgctcgatttagagtgagctcgttggggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccgccctcct

SEQ ID NO: 597081 - DNA, 509 bp, Homo sapiens; identical to SEQ ID NO: 560392
  misc_feature: HIJSMM301BVWHN.5.24.C02.1.454.light.4.raw

SEQ ID NO: 597082 - DNA, 499 bp, Homo sapiens
  misc_feature: HIJSMM301CSN8L.16.38.D05.1.454.light.4.raw
tgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaagcgccaccctctcctgcagggccagtcagagtgttgccaccaatttagcctggtaccagcaaaaacctggccaggctcccaggctcctcatctatggtgcatctaccagggccactgatgtcccaggccggttcagtggcagtgggtttgggacagacttcactctcaccatcagcaccctgcagtctgaggattttgcaattttattattgtcagcagtataattactggcctccgtacacttttggccaggggccaagctggagatcaaacgaactgtggctgcaccatctgtcttcat

SEQ ID NO: 597083 - DNA, 479 bp, Homo sapiens
  misc_feature: HIJSMM301EQQYH.11.17.B06.1.454.light.4.raw
cgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagtattttgcaacttactactgtcaacagagttacagtaccccgtggacgttcggccaaggaccaaggtggaaatacaaacgaactagtggctgca

SEQ ID NO: 597084 - DNA, 499 bp, Homo sapiens
  misc_feature: HIJSMM301ELJSQ.13.50.E06.1.454.light.4.raw
tcacgtactacacgaccggtgctcgatttagatctactgacaacacacaagggggctgtaggctcaggaggcagagctctgaatgtctcaccatggcctggatccctctcctgctccccctcctcattctctgcacagtctctgtgacctcctatgaactgacacagccatcctcagtgtcagtgtctccgggacagacggccaggatcacctgctcaggaaatattctgacaaaaaaatatgctcggtggttccagcagaagccaggccaggccccagtactggtgatttataaagacattgagcggccctcagggatccctgagcgattctccggctctaattcagggaccacagtcaccttgaccatcaccggggcccagattgaggatgaggctgactattattgttactctgcggctgacaaccatctggttttcggcgggggaccaagttgacgtcgtggtcagcccaaggctgccccctcggtcactctccg

SEQ ID NO: 597085 - DNA, 511 bp, Homo sapiens
  misc_feature: HIJSMM301ENM09.7.34.D01.1.454.light.4.raw
cgtgtctctacacgaccggtgctcgatttagatcgtctgtgttgggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaaactcttgatttatgatgtctctaatcggccctcggcgtttctattcgcttctctggctccaagtctggcaacacggcctccctgaccatctctggactccagactgaggacgaggctgattattactgctgctcatatacaggggacagcattatttgggtgttcggcggagggaccaagctgaccgtcctgcgtcagcccaaggctgccccctcggtcact

SEQ ID NO: 597086 - DNA, 479 bp, Homo sapiens
  misc_feature: HIJSMM301DE1KK.16.81.H04.1.454.light.4.raw
  modified_base (424)..(424): a, c, t, g, unknown or other
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattnaactttcgccctgggaccaatgtggatatcaaacgaactgtggctgcacatctgt

SEQ ID NO: 597087 - DNA, 486 bp, Homo sapiens
  misc_feature: HIJSMM301AVPYV.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgctaacttattactgtctacaagattaccacttaccctgggacgttcggccaacgggaccaacggtaggaatacaacgaactggtggctgcaccta

SEQ ID NO: 597088 - DNA, 487 bp, Homo sapiens
  misc_feature: HIJSMM301BJ7DO.49.83.H06.1.454.light.4.raw
agtcgagagacacgaccggtgctcgatttagatcacgtgcgtcgcgggggagtcagacccagtcaggatacagcatggacatgagggtccccgctcagctcctggggctcctgctgctctggctcccaggtcccaaatgtgacatccagatgacccagtctccttccaccctgtctgcatctgtaggagacagagtcaccatcacttgccgggccagtcagaatattaataagtggttggcctggtatcagcagataccagggaaagcccctaaactcctgatctatgaggcgtctagtttagaaagtggggtcccttcaaggttcagcggcagtggatctgggacagaattcactctcaccatcaacagcctgcagcctgatgattttgcaacttattactgccaacactataatcattattctccggccactttcggccctgggaccaggctagatatcggacgaactgtggctgcaccatctgt

SEQ ID NO: 597089 - DNA, 489 bp, Homo sapiens; identical to SEQ ID NO: 550920
  misc_feature: HIJSMM301CGISP.41.23.C01.1.454.light.4.raw

SEQ ID NO: 597090 - DNA, 513 bp, Homo sapiens
  misc_feature: HIJSMM301BIO2U.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctggtcactctgttccccacctcctcgagtagtaca

SEQ ID NO: 597091 - DNA, 484 bp, Homo sapiens
  misc_feature: HIJSMM301BYNJJ.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctggaccaggtcaccgtcctaggtcagcccaaggccaaccca

SEQ ID NO: 597092 - DNA, 519 bp, Homo sapiens
  misc_feature: HIJSMM301ALX8F.43.53.E09.1.454.light.4.raw
tgtgagtagtcacgaccggtgctcgatttagagagagtgtggtgggtttgggggggggtcacaagaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgaccatctctgggctccaggctgaggacgaggctgattattactgcaactcacttacaacgaccgacacttgcgtattcggcggcgggaccaagctgaccgtcctaggtcagcccaaggctgccccctcggtcactctgttccccg

SEQ ID NO: 597093 - DNA, 485 bp, Homo sapiens; identical to SEQ ID NO: 535501
  misc_feature: HIJSMM301ATWO3.3.10.A10.1.454.light.4.raw

SEQ ID NO: 597094 - DNA, 500 bp, Homo sapiens; identical to SEQ ID NO: 540219
  misc_feature: HIJSMM301CW8HU.43.34.D01.1.454.light.4.raw

SEQ ID NO: 597095 - DNA, 511 bp, Homo sapiens
  misc_feature: HIJSMM301D0ML6.48.37.D04.1.454.light.4.raw
agtatacatacacgaccggtgctcgatttagtagcatactgttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaattttgtattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctcgttcccaccct

SEQ ID NO: 597096 - DNA, 465 bp, Homo sapiens
  misc_feature: HIJSMM301AHBUP.21.76.G10.1.454.light.4.raw
tcgtcgctcgcacgaccggtgctcgatttagtcactcatacagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatcacttgccgggcgggtcaggacattagacattatttagcctggtatcagcagaaaccaggtaaagttcccaagctcctgatctatgctgcatcctctttgcaatcaggggtcccatctcggttcagtggcagtggatctgggacagatttcactctcaccatcagcagcctgcagcctgaagatgttgcaacttattactgtcaaaaatatagcagtgcccctctcactttcggcgcagggaccaaggtggacatcaaaacg

SEQ ID NO: 597097 - DNA, 486 bp, Homo sapiens; identical to SEQ ID NO: 535385
  misc_feature: HIJSMM301EADK6.19.71.G05.1.454.light.4.raw

SEQ ID NO: 597098 - DNA, 504 bp, Homo sapiens; identical to SEQ ID NO: 535561
  misc_feature: HIJSMM301AHB36.4.57.F02.1.454.light.4.raw

SEQ ID NO: 597099 - DNA, 487 bp, Homo sapiens
  misc_feature: HIJSMM301D3FGP.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcaagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcccgccctcctcgcctacgtaga

SEQ ID NO: 597100 - DNA, 491 bp, Homo sapiens; identical to SEQ ID NO: 548535
  misc_feature: HIJSMM301AVCMH.51.71.G05.1.454.light.4.raw

SEQ ID NO: 597101 - DNA, 499 bp, Homo sapiens; identical to SEQ ID NO: 594009
  misc_feature: HIJSMM301A35RS.9.21.B10.1.454.light.4.raw

SEQ ID NO: 597102 - DNA, 505 bp, Homo sapiens
  misc_feature: HIJSMM301EA8RM.47.85.H08.1.454.light.4.raw
agctcacgtacacgaccggtgctcgatttagtatcactcagtcggcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcatatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttggtgttcggcggaggaccaagttgaccgtcctaggtcagccaaggctgccccctcgtcactctgtt

SEQ ID NO: 597103 - DNA, 521 bp, Homo sapiens; identical to SEQ ID NO: 539470
  misc_feature: HIJSMM301BP2WQ.27.23.C01.1.454.light.4.raw

SEQ ID NO: 597104 - DNA, 485 bp, Homo sapiens; identical to SEQ ID NO: 536040
  misc_feature: HIJSMM301COPCQ.15.1.A01.1.454.light.4.raw

SEQ ID NO: 597105 - DNA, 480 bp, Homo sapiens; identical to SEQ ID NO: 535630
  misc_feature: HIJSMM301E2P0M.40.59.F04.1.454.light.4.raw

SEQ ID NO: 597106 - DNA, 520 bp, Homo sapiens
  misc_feature: HIJSMM301DKJN3.12.71.G05.1.454.light.4.raw
atacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagcccaagctgccccctcggtccactctgttcccaccct

SEQ ID NO: 597107 - DNA, 506 bp, Homo sapiens
  misc_feature: HIJSMM301D0P4H.8.19.B08.1.454.light.4.raw
  modified_base (473)..(473): a, c, t, g, unknown or other
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaattagagatcaaacgaaacngtggctgcaccatctgtcttcatcttcccgcca

SEQ ID NO: 597108 - DNA, 487 bp, Homo sapiens; identical to SEQ ID NO: 549370
  misc_feature: HIJSMM301C25BA.49.53.E09.1.454.light.4.raw

SEQ ID NO: 597109 - DNA, 508 bp, Homo sapiens
  misc_feature: HIJSMM301AF2FD.3.31.C09.1.454.light.4.raw
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcaactacttagcctggtaccaacagaaacctggccaggctcccaggctcctcatctatgatgcatccaacagggccactggcatccccagccaggttcagtggcagtgggtctgggacagacttcactctcaccatcaacagactggagcctgaagattttgtcagtgtattactgtcaggtctatggttactcacctcggttcagctttggccgaggggaccgaaggtagggagatcaaacgaactagtggctgcaccatctgtcttcta

SEQ ID NO: 597110 - DNA, 492 bp, Homo sapiens; identical to SEQ ID NO: 547805
  misc_feature: HIJSMM301BA8LY.48.38.D05.1.454.light.4.raw

SEQ ID NO: 597111 - DNA, 495 bp, Homo sapiens; identical to SEQ ID NO: 573631
  misc_feature: HIJSMM301A9QQ4.26.12.B01.1.454.light.4.raw

SEQ ID NO: 597112 - DNA, 491 bp, Homo sapiens
  misc_feature: HIJSMM301CVJ98.52.38.D05.1.454.light.4.raw
cgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcacgtcctggtcagccaaggccaacccactgt

SEQ ID NO: 597113 - DNA, 519 bp, Homo sapiens
  misc_feature: HIJSMM301DL7ZA.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctggtcactctgttcccacct

SEQ ID NO: 597114 - DNA, 497 bp, Homo sapiens; identical to SEQ ID NO: 536371
  misc_feature: HIJSMM301C80GP.16.78.H01.1.454.light.4.raw

SEQ ID NO: 597115 - DNA, 487 bp, Homo sapiens
  misc_feature: HIJSMM301ENPS2.40.37.D04.1.454.light.4.raw
tctagcgactcacgaccggtgctcgatttagtagcatactgttgggtttgggggatcaggacttctcagttcatcttctcaccatgaggctccctgctcagctcctggggctgctaatgctctggatccctggttccagtgcgagggttgtgatgactcagactccactctctctgtccgtcacccctggacagccggcctccatctcctgcaagtctgctcagagcctcctgcatggtgatggaatcacctatttatattggtacctgcagaagccaggccagtctccacagctcctaatctatgaggtttccagccggttctctggagtgccagataggttcagtggcagcgggtcagtgacagatttcacactgaaaatcagccgggtggaggctgaggatggttggggtttattactgcatgcaaggtttataccttcctcgggactttcggccctcgggaccgagaggtggatgtcaaaccg

SEQ ID NO: 597116 - DNA, 509 bp, Homo sapiens
  misc_feature: HIJSMM301B6SVN.48.34.D01.1.454.light.4.raw
agtatacatacacgaccggtgctcgatttagatcgtctgtgttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgtattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagccaaggctgccccctcggtcactctgtcccaccct

SEQ ID NO: 597117 - DNA, 515 bp, Homo sapiens; identical to SEQ ID NO: 538805
  misc_feature: HIJSMM301BK6YE.14.19.B08.1.454.light.4.raw

SEQ ID NO: 597118 - DNA, 499 bp, Homo sapiens; identical to SEQ ID NO: 543360
  misc_feature: HIJSMM301ATX19.19.78.H01.1.454.light.4.raw

SEQ ID NO: 597119 - DNA, 482 bp, Homo sapiens
  misc_feature: HIJSMM301C1DYS.15.8.A08.1.454.light.4.raw
tctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgcagtctgaagattttgcagtttattactgtcagcaatataacaagtggccattcactttcggcccagggaccaaagtggatatcaaacgaactgtggctgcaccatctgtcttcatcttcccgccatctgagctacg

SEQ ID NO: 597120 - DNA, 493 bp, Homo sapiens; identical to SEQ ID NO: 540880
  misc_feature: HIJSMM301C3ZJ6.40.81.H04.1.454.light.4.raw

SEQ ID NO: 597121 - DNA, 515 bp, Homo sapiens
  misc_feature: HIJSMM301DDK05.8.33.C11.1.454.light.4.raw
ctcgcgtgtccacgaccggtgctcgatttagagtgagctcgttgggtttggggggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggccccctcatctatggtgcatccaacagggccactggcatccccagccaggttcagtggcaggtgggtatgggacagacttcactctcaccatcatcagcctggagcctgaagatgttgctagtttattactgtcaacatcgtaccgagtggccgtccgggggccacgtttccggcccgtcgggaccgaaggtggaggatcaaacgaactgtggctgcaccatctgtcttc

SEQ ID NO: 597122 - DNA, 503 bp, Homo sapiens; identical to SEQ ID NO: 546075
  misc_feature: HIJSMM301DHGLN.7.71.G05.1.454.light.4.raw

SEQ ID NO: 597123 - DNA, 484 bp, Homo sapiens
  misc_feature: HIJSMM301BGXK6.17.26.C04.1.454.light.4.raw
cgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcggtggagggaccgaaggtggagatcaaacgaactgtggctgcacc

SEQ ID NO: 597124 - DNA, 497 bp, Homo sapiens
  misc_feature: HIJSMM301EXUCV.51.59.F04.1.454.light.4.raw
cgatcgtatacacgaccggtgctcgatttagtacacacacttagggattgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactc

SEQ ID NO: 597125 - DNA, 507 bp, Homo sapiens; identical to SEQ ID NO: 545328
  misc_feature: HIJSMM301CS4NM.8.33.C11.1.454.light.4.raw

SEQ ID NO: 597126 - DNA, 518 bp, Homo sapiens
  misc_feature: HIJSMM301A7538.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgtccaacgggaccgaacggtaggaaagtacaaaacgaaactacgtaggcgtgcgaccactctgtcttctatctttccccg

SEQ ID NO: 597127 - DNA, 495 bp, Homo sapiens
  misc_feature: HIJSMM301BKU28.12.38.D05.1.454.light.4.raw
atacgacgtacacgaccggtgctcgatttagtatctgatagttgggtttgggggaactgctcagttaggacccagacggaaccatggaagccccagcgcagcttctcttcctcctgctactctggctcccagattcctctggagaagttgtgatgacgcagtctccagccaccctgtctgcgtctccaggggaaagagtcaccctctcatgcagggccagtgagattgttaccaccaacttagcctggtaccaacagaaacctggccagcctcccaggctcctcatttatggtgcatccacaagggccgctggtgtcccagccaggttcagtggcagtggatctgcgacagagttcactctcaccgtcagcagcctgcagtctgaagattttgcagtttattactgtcagcagtatgagaagtggttcaagactttcggcggagggaccaaggtggagatcaaacgaactgtggctgcaccatctgtcttcatcc

SEQ ID NO: 597128 - DNA, 474 bp, Homo sapiens
  misc_feature: HIJSMM301BZHSB.49.4.A04.1.454.light.4.raw
agtcgagagacacgaccggtgctcgatttagagtagtgatcagggcacgaccggtgctcgatttagagtagtgatcaggggcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtatgatcgcctcccgctcactttcggcgggggaacc

SEQ ID NO: 597129 - DNA, 513 bp, Homo sapiens
  misc_feature: HIJSMM301D7KMB.17.62.F07.1.454.light.4.raw
cgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctggtcactctgttcccaccctcctcctagtcctacg

SEQ ID NO: 597130 - DNA, 466 bp, Homo sapiens
  misc_feature: HIJSMM301EHOIX.13.4.A04.1.454.light.4.raw
tcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagttcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagattttactttcaccatcagcagcctgcagcctgaagatattgcaacatattactgtcagcagtatgataatcctccgatcaccttcggccaagggacacgactggagattaacgaa

SEQ ID NO: 597131 - DNA, 500 bp, Homo sapiens
  misc_feature: HIJSMM301CDQ8X.22.5.A05.1.454.light.4.raw
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccgaggggaaagagccaccctctcctgcagggccagtcagagtgttaactactacttagcctggtaccaacagaaacctgaccaggctcccaggctcctcatctatgatgcatcttacagggccactggcatcccagccaggttcagtggcagtgggtctgggacagacttcactctcaccatcagcagcctagagcctgaagattttgcagtttattactgtcagcagcgtagcaactccctcacgttcggcggagggaccaaggtggagatcaaacgaactgtggctgcaccatctgtcttcattcttcctgcccta

SEQ ID NO: 597132 - DNA, 499 bp, Homo sapiens; identical to SEQ ID NO: 568292
  misc_feature: HIJSMM301DNUQ5.52.78.H01.1.454.light.4.raw

SEQ ID NO: 597133 - DNA, 501 bp, Homo sapiens
  misc_feature: HIJSMM301BXCD6.18.23.C01.1.454.light.4.raw
tacgagtatgcacgaccggtgctcgatttagtacacgtgattagggattgggggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaagctgcagatgattggtccgtccagtttccaagatggggccccatcgagattccgcgtcagtggatctgggacagatttcactctcaccatcagcagcctgcagcctgaagattttgcaacttactattgtcaacaggctgacaggttcccgctgactttcggcggagggaccaaggtagagatcaaaggaactgtggctgcaccatctgtcttcatcttcccg

SEQ ID NO: 597134 - DNA, 504 bp, Homo sapiens
  misc_feature: HIJSMM301EMNCM.48.30.C08.1.454.light.4.raw
agtatacatacacgaccggtgctcgatttagtctgacgtcaaagggaaagggggaggttctttctctgggatgtggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagtacttttagtttacgtcggaccttcggccaagggacacgactggagattaaacgaactgtggctgcacc

SEQ ID NO: 597135 - DNA, 498 bp, Homo sapiens
  misc_feature: HIJSMM301B7FML.52.31.C09.1.454.light.4.raw
  modified_base (239)..(239): a, c, t, g, unknown or other
cgcagtacgacacgaccggtgctcgatttagacgtctcatcaaggaaggaagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatntgcttattggtaccagcagaggtcaggccaggcccctatattgatcatctatgaagacagcaaacgacccgctgggatccctcagagattctctggctccagctcagggacaatggccaccttgactatcactggggcccaggtggaggatgaagctgccttctattgtttttcaactagacagcagtggtaatcatagggtgttcggcggagggaccaggctgaccgtcctaggtcagcccaaggctcgcccctcggt

SEQ ID NO: 597136 - DNA, 507 bp, Homo sapiens
  misc_feature: HIJSMM301BLA4O.48.28.C06.1.454.light.4.raw
agtatacatacacgaccggtgctcgatttagagctcacgtattgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtgtcccagccaggttcactggcggtgggtctgggacagagttcactctcaccatcagcagcctgcagtctgaagattttacattttattactgtcagcagtatcgtaagtggactccgacgtttggccaagggaccaaggtggaagtcaaacgaactgtggctgcaccatctgtcttcatcttcccgccta

SEQ ID NO: 597137 - DNA, 460 bp, Homo sapiens; identical to SEQ ID NO: 536053
  misc_feature: HIJSMM301C7MRR.22.28.C06.1.454.light.4.raw

SEQ ID NO: 597138 - DNA, 503 bp, Homo sapiens
  misc_feature: HIJSMM301EMYOT.40.67.G01.1.454.light.4.raw
tctagcgactcacgaccggtgctcgatttagagtatacatattgggtttgggggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtgggtctgggacagccttcactctcaccatcagcagcctggagcccgaagattttgcggtttattactgtcagcagcgtgccgactggcccctcacgttcggcggagggaccaaggtggacatcaaacgaactgtggctgcacatctgtcttcatcttcccgccat

SEQ ID NO: 597139 - DNA, 502 bp, Homo sapiens
  misc_feature: HIJSMM301CJ4TQ.10.71.G05.1.454.light.4.raw
catagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcaggtgggtctgggacagacttcactctcaccatcagcagcctagagcctgaagattttgcagtttattactgtcagcagcgtgccactttcggcggaggtgccactttcggcggagggaccaaatagaggtcaaacgaactgtggctgcaccatctgtcttcatt

SEQ ID NO: 597140 - DNA, 488 bp, Homo sapiens
  misc_feature: HIJSMM301CY808.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgcaacagtatcatcatcattgtaatttcggtggagggaccaaggtggaggtcaaacgaactgtggctgcacatctgtcttcat

SEQ ID NO: 597141 - DNA, 508 bp, Homo sapiens
  misc_feature: HIJSMM301AKDXX.8.1.A01.1.454.light.4.raw
ctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgccaaagaaatatgcttattggtaccagcagaagtcaggccaggcccctgtcctggtcatttatgaggacaagaaacgaccctccgggatccctgacagactctctggctccagctcagggacagtggccaccttgactatcactggggcccaggtggaggatgaaggagactactattgttactctccagagaaggatggtcatcattgggtgttcggcggagggaccgaagctgaccgtcctaagtcagcccaaggctgccccctcggtccactctgttcccgaccct

SEQ ID NO: 597142 - DNA, 499 bp, Homo sapiens
  misc_feature: HIJSMM301BC3I2.48.1.A01.1.454.light.4.raw
agtatacatacacgaccggtgctcgatttagacgtctcatcaggggggagtcagacccagtcaggactcagcatggacatgagggtccccgcccagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatctggggcagagttcattctcaccatcaacagccttcagcctgaagattttgcaacttactattgtcagcagggtgacagtttccctcccactttcggcggagggaccagggtggacgtcaaacgaactgtggctgcaccatctgtcttcatcttcccgccta

SEQ ID NO: 597143 - DNA, 511 bp, Homo sapiens; identical to SEQ ID NO: 543656
  misc_feature: HIJSMM301CQKD3.15.86.H09.1.454.light.4.raw

SEQ ID NO: 597144 - DNA, 489 bp, Homo sapiens; identical to SEQ ID NO: 542780
  misc_feature: HIJSMM301BSR0Y.16.53.E09.1.454.light.4.raw

SEQ ID NO: 597145 - DNA, 468 bp, Homo sapiens; identical to SEQ ID NO: 585594
  misc_feature: HIJSMM301BXN2N.5.36.D03.1.454.light.4.raw

SEQ ID NO: 597146 - DNA, 503 bp, Homo sapiens; identical to SEQ ID NO: 568855
  misc_feature: HIJSMM301EEI2T.9.71.G05.1.454.light.4.raw

SEQ ID NO: 597147 - DNA, 435 bp, Homo sapiens
  misc_feature: HIJSMM301AMBQ8.18.5.A05.1.454.light.4.raw
tacgagtatgcacgaccggtgctcgatttagatagatagacagggtggaaggagactgggacatccagatgacccagtctccttccaccctgtctgcatctgtaggagacagagtcaccatctcttgccgggccactcagagtattagtatctggttggcctggtatcagcagaaaccagggaaagcccctaagctcctgatcgagaaggcgtctagtttagaaagtggggtcccatcaaggtttagcggcagtggatctgggacagaattcactctcaccatcagcagcctgcagcctgatgattttgcaacttattactgccaacattataatacttattcgtacacttttggtcaggggaccaagctggagatcaaacgaactgtggctgcaccatctgtcttcatcttcccgccatctgacatacctcgta

SEQ ID NO: 597148 - DNA, 506 bp, Homo sapiens
  misc_feature: HIJSMM301CIY5T.8.28.C06.1.454.light.4.raw
ctcgcgtgtccacgaccggtgctcgatttagagctcacgtattgggtttgggggaggaactgctcagttaggacccagacggaaccataggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatcttcccgcc

SEQ ID NO: 597149 - DNA, 514 bp, Homo sapiens
  misc_feature: HIJSMM301C2V2L.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctacttactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccggcctaggtcagcccaaggctgccccctcggtcactctgttcccaccctcctcgagtagtaca

SEQ ID NO: 597150 - DNA, 494 bp, Homo sapiens; identical to SEQ ID NO: 534992
  misc_feature: HIJSMM301DVC6F.9.1.A01.1.454.light.4.raw

SEQ ID NO: 597151 - DNA, 485 bp, Homo sapiens; identical to SEQ ID NO: 535501
  misc_feature: HIJSMM301CR0MO.3.10.A10.1.454.light.4.raw

SEQ ID NO: 597152 - DNA, 512 bp, Homo sapiens; identical to SEQ ID NO: 548540
  misc_feature: HIJSMM301CCDO4.15.76.G10.1.454.light.4.raw

SEQ ID NO: 597153 - DNA, 513 bp, Homo sapiens
  misc_feature: HIJSMM301DKM2B.48.66.F11.1.454.light.4.raw
agtatacatacacgaccggtgctcgatttagtcacgcgagaaggggggaagcctgagaacacttagccttcatgagtgtccccaccatggcctggatgatgcttctcctcggactccttgcttatggatcaggcgtgcattctcagagtgtggtgacccaggaaccatcgttctcagtgtcccctggagggacagtcacactcacttgtggcttgacttctggctcagtcgcgccggtccactaccccagttggtaccaacagatcccaggccaggctccacgcacgctcatcttcatgaaacagattcgctcttctggggtccctgatcggttttctggctccatcgttgggggcaaagccgccctcaccatcacgggggcccaggcagaggatgaggcgaattattattgtatgctccacaggggcaggggcacctgggagttcggcggcgggaccaagctgaccgtcctaggtcagcccaaggctgccccctcggtcactctgttcccta

SEQ ID NO: 597154 - DNA, 503 bp, Homo sapiens; identical to SEQ ID NO: 547049
  misc_feature: HIJSMM301BCXBA.18.59.F04.1.454.light.4.raw

SEQ ID NO: 597155 - DNA, 485 bp, Homo sapiens; identical to SEQ ID NO: 587571
  misc_feature: HIJSMM301DQYMX.10.53.E09.1.454.light.4.raw

SEQ ID NO: 597156 - DNA, 482 bp, Homo sapiens; identical to SEQ ID NO: 535216
  misc_feature: HIJSMM301EIYKA.17.26.C04.1.454.light.4.raw

SEQ ID NO: 597157 - DNA, 503 bp, Homo sapiens; identical to SEQ ID NO: 538884
  misc_feature: HIJSMM301BRT85.27.78.H01.1.454.light.4.raw

SEQ ID NO: 597158 - DNA, 490 bp, Homo sapiens
  misc_feature: HIJSMM301E2ADS.48.77.G11.1.454.light.4.raw
agtatacatacacgaccggtgctcgatttagctagtcactcaagggaaaggggagagctctggggaggaactgctcagttaggacccagacggaaccatggaagccccagcgcagcttctcttcctcctgctactctggctcccagataccactggagaagtactgatgacgcagtctccagccaccctgtctgtgtctccaggggaaagagccaccctctcctgcagggccagtcagagtgttagcagcaacttagcctggtaccagcagaagcctggccaggctcccaggctcatcatctatggtgcatccaccagggccactggttgcccagcccggttcagtggtagtgggtctgggacagagttcagtctcaccatcagcagcctgcagtctgaagactttgcagtttattactgtcagcagtatgataactggcctccgttcacctcggcggcgggaccgaaggtggagatcaaacgaaactgt

SEQ ID NO: 597159 - DNA, 489 bp, Homo sapiens
  misc_feature: HIJSMM301EF9L3.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaaacaatattattatacttcgtggacgttcggccaagggaccaaggtggataatcagaacgaa

SEQ ID NO: 597160 - DNA, 483 bp, Homo sapiens; identical to SEQ ID NO: 555750
  misc_feature: HIJSMM301EPQWY.41.78.H01.1.454.light.4.raw

SEQ ID NO: 597161 - DNA, 505 bp, Homo sapiens; identical to SEQ ID NO: 577484
  misc_feature: HIJSMM301AIR6D.19.78.H01.1.454.light.4.raw

SEQ ID NO: 597162 - DNA, 506 bp, Homo sapiens
  misc_feature: HIJSMM301DPK0C.12.50.E06.1.454.light.4.raw
atacgacgtacacgaccggtgctcgatttagatctactgacaacacacaaggggggagaagagctgctcagttaggacccagagggaaccatggaaaccccagcgcagccttctcttcctcctgctactctggctcccagataccaccggagaaattgtgttgacgcagtctccaggcaccctgtctttgtctccgggggaaagagtcaccctctcctgcagggccagtcagagtgttagcggcaactacttagcctggtaccaacagaaacctggccaggctcccaggctcgtcatctatggtgcatccagcagggccactggcatcccagacaggttcagtggcagtgggtctgggacagacttcactctcaccatcagtagactggagcctgaagattttgctagtttattactgtcagcagtagtgggggctcacgtcgattcactttcggccctgggaccaaagtagatgtcaaacgaactgtggctgcaccatctgtctt

SEQ ID NO: 597163 - DNA, 497 bp, Homo sapiens; identical to SEQ ID NO: 535740
  misc_feature: HIJSMM301DS9EG.3.71.G05.1.454.light.4.raw

SEQ ID NO: 597164 - DNA, 487 bp, Homo sapiens; identical to SEQ ID NO: 539157
  misc_feature: HIJSMM301EECR3.26.37.D04.1.454.light.4.raw

SEQ ID NO: 597165 - DNA, 453 bp, Homo sapiens; identical to SEQ ID NO: 556974
  misc_feature: HIJSMM301EA9UX.19.86.H09.1.454.light.4.raw

SEQ ID NO: 597166 - DNA, 502 bp, Homo sapiens
  misc_feature: HIJSMM301EW6U8.5.86.H09.1.454.light.4.raw
atcagacacgcacgaccggtgctcgatttagtgctatagacttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcgagggaccaagctgaccgtcctaggtcagcccaaggctgccccctcggtca

SEQ ID NO: 597167 - DNA, 495 bp, Homo sapiens
  misc_feature: HIJSMM301C7YMY.2.49.E05.1.454.light.4.raw
acgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagagcggccccaagctcctcatctatagaaattatgaacggtcctcaggggtccctgaccgattctctggctccaagtctggcacctcagcctccctggccatcagtgggctccggtccgaggatgaggctgattattactgtgttggatgggacagcagcctgagtgcttatgtcttcggaactggaccacggtcaccgtcct

SEQ ID NO: 597168 - DNA, 484 bp, Homo sapiens; identical to SEQ ID NO: 554992
  misc_feature: HIJSMM301AL0S4.46.26.C04.1.454.light.4.raw
  modified_base (433)..(433): a, c, t, g, unknown or other

SEQ ID NO: 597169 - DNA, 509 bp, Homo sapiens; identical to SEQ ID NO: 541829
  misc_feature: HIJSMM301DFRLX.17.28.C06.1.454.light.4.raw

SEQ ID NO: 597170 - DNA, 501 bp, Homo sapiens
  misc_feature: HIJSMM301EJGRW.40.43.D10.1.454.light.4.raw
tctagcgactcacgaccggtgctcgatttagactagcagtaagggggaggaactgctcagttaggacccagagggaaccatggaagccccagctcagcttctcttcctcctgctactctggctcccagaaaacaccggagaaattctgttgacacagtctccaggcaccctgtctttgtctccaggggaaagagccaccctctcctgcagggccagtcagagtgtcggcaccttcttagcctggtaccaacagaagcctggccaggctcccaggctcctcatttatgaagcgtcgaacagggccactggcatcccagccaggttcagtgccagtgggtctgggacagacttcactctcaccatcagcagcctagagcctgaagattttgcactttattactgtcaccagcgtagcagctggcctcgaacgttcgccaggaccaaggtggacgatcaagcgaactagtggctgcaccatctgtcttctatcttcccgccact

SEQ ID NO: 597171 - DNA, 482 bp, Homo sapiens; identical to SEQ ID NO: 535352
  misc_feature: HIJSMM301D4VDA.16.81.H04.1.454.light.4.raw

SEQ ID NO: 597172 - DNA, 486 bp, Homo sapiens; identical to SEQ ID NO: 535458
  misc_feature: HIJSMM301EFF6J.7.75.G09.1.454.light.4.raw

SEQ ID NO: 597173 - DNA, 493 bp, Homo sapiens; identical to SEQ ID NO: 551874
  misc_feature: HIJSMM301EQNM5.18.11.A11.1.454.light.4.raw

SEQ ID NO: 597174 - DNA, 506 bp, Homo sapiens
  misc_feature: HIJSMM301A6ZJE.10.70.G04.1.454.light.4.raw
catagtagtgcacgaccggtgctcgatttagtgtagtgtgaagggaaagggggggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggttatgatgtacactggtaccagcaacttcccggaacagcccccacgctcctcatctatggtgacaccaaccggccctcaggggtccctgagcgattctctgggtccaagtctggcacctcggcctccctggccatcactgggctccaggctgaggatgaggctgattattactgccagtcccatgacaacagcctgagtgttgggtgttcggcggagggaccaagctgaccgtccttagtcagcccaaggctgccccctcggtcactctgttcccaccctcctccta

SEQ ID NO: 597175 - DNA, 495 bp, Homo sapiens
  misc_feature: HIJSMM301BCNWE.51.83.H06.1.454.light.4.raw
cgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagtttattattgtcagcagcgaaacaactggcctccttggacgttcggccaaggaccaaggtggaaatcaaacgaactgtggctgcaccatctgtcttcatt

SEQ ID NO: 597176 - DNA, 444 bp, Homo sapiens; identical to SEQ ID NO: 535594
  misc_feature: HIJSMM301DUTO1.9.9.A09.1.454.light.4.raw

SEQ ID NO: 597177 - DNA, 444 bp, Homo sapiens; identical to SEQ ID NO: 535192
  misc_feature: HIJSMM301AF27R.5.9.A09.1.454.light.4.raw

SEQ ID NO: 597178 - DNA, 484 bp, Homo sapiens
  misc_feature: HIJSMM301EAH0K.51.76.G10.1.454.light.4.raw
cgatcgtatacacgaccggtgctcgatttagtcactcatacaggggagagctctggggaggaactgctcagttaggacccaggcggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgaagattttgcaatttattactgtcagcagtataataactggcctccgtactacttttggccaggggaccaagctggagatacaaacgaactgt

SEQ ID NO: 597179 - DNA, 494 bp, Homo sapiens
  misc_feature: HIJSMM301A1K92.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaacgggaccaagtaggacatcaagcgaactagtggcgtgcaccatactgt

SEQ ID NO: 597180 - DNA, 479 bp, Homo sapiens
  misc_feature: HIJSMM301ESEEC.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacacagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgaagattttgcagtttattactgtcagcactataataactggcctccgtacattttggccaggggaccaagctggagatcaaacgaa

SEQ ID NO: 597181 - DNA, 502 bp, Homo sapiens
  misc_feature: HIJSMM301BWYFQ.49.82.H05.1.454.light.4.raw
agtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagcggccctcaggggtctctgatcgcttctctggctccacgtctggcagcacggcctccctgacaatctctgggctccaggctggggacgaggctgattattattgctgttcatatgccggtgatagtggccgaagggtgttcggcggagggaccaaggtgaccgtctaggtcagcccaaggctgccccctcggt

SEQ ID NO: 597182 - DNA, 510 bp, Homo sapiens
  misc_feature: HIJSMM301DTV3D.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgctagtttattactgtcaacatcgtaccgagtcggccgtccggggccactttcggccctggaccgaagtggatatacaaacgaactgtggctgcaccatctgtcttcta

SEQ ID NO: 597183 - DNA, 505 bp, Homo sapiens
  misc_feature: HIJSMM301B2X0M.15.5.A05.1.454.light.4.raw
tctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgcccctcggtcactctgttcccgcctcctcgctacgtaga

SEQ ID NO: 597184 - DNA, 504 bp, Homo sapiens
  misc_feature: HIJSMM301BIPI2.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggtccaagggaccgaacggtgggagtatcagacgaacgtagtggtctgg

SEQ ID NO: 597185 - DNA, 494 bp, Homo sapiens
  misc_feature: HIJSMM301A3XS3.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactgagattaaaacgaactgtggctgcaccatctgtctt

SEQ ID NO: 597186 - DNA, 490 bp, Homo sapiens
  misc_feature: HIJSMM301BJ4EM.26.80.H03.1.454.light.4.raw
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagtttttaccctcacaactcatatcacagaatctgaggatgctgcattttactcggtctacaacatgataattccctcgtggacgttcgcaaggaccaaggagcaaatcaaacgaactgtggctgcaccatctgtcttcatctcccgccat

SEQ ID NO: 597187 - DNA, 489 bp, Homo sapiens; identical to SEQ ID NO: 536663
  misc_feature: HIJSMM301EWOQK.16.72.G06.1.454.light.4.raw

SEQ ID NO: 597188 - DNA, 492 bp, Homo sapiens
  misc_feature: HIJSMM301A0BTT.49.28.C06.1.454.light.4.raw
agtcgagagacacgaccggtgctcgatttagagctcacgtattgggtttgggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccgaccctctcctgcagggccactcagagtgttagcacctacttagcctggtaccaacagagacctggccagcctcccaggctcctcatctatgctgcgtccagcagggccactggcatcccggacaggttcagtggcagtgggtctgggacagacttctctctcaccatcagcagactggagcctgaagattttgcagtatattactgtcagcatgggagcattcgtgcgctcaccttcggcggagggaccaaggtggagatcaaacgaactgtggctgcaccatctgtt

SEQ ID NO: 597189 - DNA, 527 bp, Homo sapiens
  misc_feature: HIJSMM301B2P8M.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgtcgccgacggaccgaacggtaggaaggtacgtaaacgaacgtaagtaggtacgtgtcaccactacctgtcttctactcttcccgtccctact

SEQ ID NO: 597190 - DNA, 490 bp, Homo sapiens; identical to SEQ ID NO: 541974
  misc_feature: HIJSMM301BVX9Z.22.65.F10.1.454.light.4.raw

SEQ ID NO: 597191 - DNA, 509 bp, Homo sapiens; identical to SEQ ID NO: 543772
  misc_feature: HIJSMM301C9HMR.2.21.B10.1.454.light.4.raw

SEQ ID NO: 597192 - DNA, 516 bp, Homo sapiens; identical to SEQ ID NO: 552129
  misc_feature: HIJSMM301AZMGO.27.23.C01.1.454.light.4.raw

SEQ ID NO: 597193 - DNA, 500 bp, Homo sapiens
  misc_feature: HIJSMM301BVP0U.12.18.B07.1.454.light.4.raw
atacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccaggggaaagagcaaccctctcctgcagggccagtcagagtgttaacagatacttagcctggtaccagcagagacctggccaggctcccaggctcctcatctatgatacattgaagagggccactggcatctcaggcagattcaatggcagtgggtctgggacagacttcactctcaccctcaccagcctagagcctgaagattttggaatttattactgtcaacagcgtagcaactggcctcccactttcggcggagggaccaaggtggagatcaagcgaactgtggctgcaccatctgtcttcatccttcccgcct

SEQ ID NO: 597194 - DNA, 476 bp, Homo sapiens
  misc_feature: HIJSMM301BVVDM.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcagtcgtgggacagcagcactgcccgctatgtcttcggaactgggaccaaggtcaccgtcctaagtcagaccccg

SEQ ID NO: 597195 - DNA, 493 bp, Homo sapiens; identical to SEQ ID NO: 540127
  misc_feature: HIJSMM301DX2D0.10.17.B06.1.454.light.4.raw

SEQ ID NO: 597196 - DNA, 479 bp, Homo sapiens; identical to SEQ ID NO: 535188
  misc_feature: HIJSMM301DVFLH.10.74.G08.1.454.light.4.raw

SEQ ID NO: 597197 - DNA, 361 bp, Homo sapiens; identical to SEQ ID NO: 544890
  misc_feature: HIJSMM301BJXUR.3.57.F02.1.454.light.4.raw

SEQ ID NO: 597198 - DNA, 520 bp, Homo sapiens
  misc_feature: HIJSMM301C8REU.40.87.H10.1.454.light.4.raw
tctagcgactcacgaccggtgctcgatttagcagtactgcgttgggtttgggggcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatttcttgttctggaagcaactccaatatcggaactaattatgtatactggtaccagcagctcccaggaacggcccccaaagtcctcttctataggaataatcaacggccctcaggggtccctgaccgattctctgcctccaagtctggcacctctgtgtccctggccatcagtgggctccggtccgaagatgagggtgactattactgtgcagcttgggatgagagcctgagaggttggctgttcggcggagggaccaagctgaccgtcctaggtcagcccaaggctgccccctcggtcactctccg

SEQ ID NO: 597199 - DNA, 487 bp, Homo sapiens; identical to SEQ ID NO: 538190
  misc_feature: HIJSMM301BNCCI.47.70.G04.1.454.light.4.raw

SEQ ID NO: 597200 - DNA, 506 bp, Homo sapiens
  misc_feature: HIJSMM301CJDZ3.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgtttcacttttcggcggagggaccaaggtggacctcaaacgaactgtggctgcaccatctgtcttcatcttccgcc

SEQ ID NO: 597201 - DNA, 510 bp, Homo sapiens
  misc_feature: HIJSMM301C57FA.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcgccgaaggaccgaaggtggaagtacaaacgaactagtggcgtgcaccatctgtcttctatcttcccgtccact

SEQ ID NO: 597202 - DNA, 480 bp, Homo sapiens; identical to SEQ ID NO: 535630
  misc_feature: HIJSMM301D8UKK.40.59.F04.1.454.light.4.raw

SEQ ID NO: 597203 - DNA, 502 bp, Homo sapiens; identical to SEQ ID NO: 537363
  misc_feature: HIJSMM301D2GAJ.18.23.C01.1.454.light.4.raw

SEQ ID NO: 597204 - DNA, 507 bp, Homo sapiens; identical to SEQ ID NO: 569798
  misc_feature: HIJSMM301AO9UN.43.67.G01.1.454.light.4.raw

SEQ ID NO: 597205 - DNA, 490 bp, Homo sapiens
  misc_feature: HIJSMM301DR2AB.8.53.E09.1.454.light.4.raw
ctcgcgtgtccacgaccggtgctcgatttagagagagtgtgttgggtttgggggcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcgcgggaccaagttgaccgtcctacg

SEQ ID NO: 597206 - DNA, 492 bp, Homo sapiens; identical to SEQ ID NO: 540973
  misc_feature: HIJSMM301ELXFX.43.20.B09.1.454.light.4.raw

SEQ ID NO: 597207 - DNA, 507 bp, Homo sapiens
  misc_feature: HIJSMM301EIZYL.19.78.H01.1.454.light.4.raw
tactctcgtgcacgaccggtgctcgatttagtgtgagtagtttgggtttggggggggtcacgaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtca

SEQ ID NO: 597208 - DNA, 505 bp, Homo sapiens; identical to SEQ ID NO: 535503
  misc_feature: HIJSMM301BUHY2.8.28.C06.1.454.light.4.raw

SEQ ID NO: 597209 - DNA, 486 bp, Homo sapiens; identical to SEQ ID NO: 535458
  misc_feature: HIJSMM301DHMJV.7.75.G09.1.454.light.4.raw

SEQ ID NO: 597210 - DNA, 495 bp, Homo sapiens; identical to SEQ ID NO: 557386
  misc_feature: HIJSMM301AYXJG.27.78.H01.1.454.light.4.raw

SEQ ID NO: 597211 - DNA, 489 bp, Homo sapiens
  misc_feature: HIJSMM301AY27L.16.72.G06.1.454.light.4.raw
tgtactactccacgaccggtgctcgatttagctacgactgcaagggaaagggggaggaactgctcagttaggacccagacggaaccatggaagccccagcgcagcttctcttcctcctgctactctggctcccagatacctctggagaaacagtgatgacgcagtctccagccaccctctctgtgtctccaggggaaagagtcaccctctcctgcagggccagtcagagtgttagcagcaacttagcctggtatcagcagaaacctggccaggctcccaggctcctcatctatggtgcatccaccagggccactggtatcccagccaggttcagtggcagtgggtctgggacagagttcactctcaccatcagcagcctgcagtctgaagatttgcggtttattactgtcagcagtataataactggcctccacggtacacttttggccaggggaccaagctggagatcaaacgaactgtggctgcacc

SEQ ID NO: 597212 - DNA, 508 bp, Homo sapiens; identical to SEQ ID NO: 536388
  misc_feature: HIJSMM301ETMM0.11.57.F02.1.454.light.4.raw

SEQ ID NO: 597213 - DNA, 485 bp, Homo sapiens
  misc_feature: HIJSMM301A0G6T.40.8.A08.1.454.light.4.raw
tctagcgactcacgaccggtgctcgatttagcatactctacagggggagctacaacaggcaggcaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccagccagactgttttatacagctccaacaatgagaactacgttgcttggtaccagcagaaaccaggacagcctcctaagttgctcatttactgggcatctacccgggcatccggggtccctgaccgattcagtggcagcgggtctgggacagatttcactctcaccatcaacaacctgcaggctgaagatgtggcagtttattactgtcaacaatattatactactccgctctacgttcgggcgaggcaaccaaggtacggaagatcgagacgaa

SEQ ID NO: 597214 - DNA, 505 bp, Homo sapiens
  misc_feature: HIJSMM301BTTC6.13.3.A03.1.454.light.4.raw
tcacgtactacacgaccggtgctcgatttagagagcgtcacaggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaactcattatttacggggtcaataagcgccctcagggctttctgatcgcttctctggctcaagtctggcaacacggcctccctgacaatctctggactccaggccgaggacgaggctgtatttttactgttgttcatatgcaggaaggagtgattatgtctttggaagtggaccaaggtcaccgtcttggtcagcccaggccaacccactgtcactctgttcccg

SEQ ID NO: 597215 - DNA, 494 bp, Homo sapiens
  misc_feature: HIJSMM301CYBW0.46.26.C04.1.454.light.4.raw
  modified_base (414)..(414): a, c, t, g, unknown or other
  modified_base (435)..(435): a, c, t, g, unknown or other
  modified_base (482)..(482): a, c, t, g, unknown or other
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatacagcagagtggaggctgaggagtgttgggngtctattatttgcatgcaagnctacaagtcccgctcacttcgtcggagggacgaacggaggagagtanaacgaaactacg

SEQ ID NO: 597216 - DNA, 481 bp, Homo sapiens; identical to SEQ ID NO: 535993
  misc_feature: HIJSMM301AGOGK.21.25.C03.1.454.light.4.raw

SEQ ID NO: 597217 - DNA, 473 bp, Homo sapiens
  misc_feature: HIJSMM301ARGFW.16.86.H09.1.454.light.4.raw
tgtactactccacgaccggtgctcgatttagtgctatagacttgggtttggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaaccccactgtcactctgttcccgccctcctcgagtagtaca

SEQ ID NO: 597218 - DNA, 486 bp, Homo sapiens; identical to SEQ ID NO: 563598
  misc_feature: HIJSMM301CU285.14.53.E09.1.454.light.4.raw

SEQ ID NO: 597219 - DNA, 476 bp, Homo sapiens; identical to SEQ ID NO: 538611
  misc_feature: HIJSMM301BJX2L.7.81.H04.1.454.light.4.raw

SEQ ID NO: 597220 - DNA, 517 bp, Homo sapiens; identical to SEQ ID NO: 590373
  misc_feature: HIJSMM301B27WS.8.87.H10.1.454.light.4.raw

SEQ ID NO: 597221 - DNA, 491 bp, Homo sapiens; identical to SEQ ID NO: 537488
  misc_feature: HIJSMM301DOYX9.15.3.A03.1.454.light.4.raw

SEQ ID NO: 597222 - DNA, 491 bp, Homo sapiens
  misc_feature: HIJSMM301EFD2X.14.55.E11.1.454.light.4.raw
  modified_base (428)..(428): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccccctnacctttcggcggagggaccaaggcggagatcagacgaactgtggctgcaccatctgtcttcta

SEQ ID NO: 597223 - DNA, 516 bp, Homo sapiens
  misc_feature: HIJSMM301CKJ83.13.81.H04.1.454.light.4.raw
tcacgtactacacgaccggtgctcgatttagtagtgtagattcgcggggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtcaagactatgtctcctggtaccaacaacacccaggcaaggcccccaaactcataatttatgatttcactaatcggccctcaggtgtatctaatcgcttcactggctccaagtctggcaacacggcctccctgaccatctctgggctccaggcagaggacgaggctgattattactgcggctcctggacgattagcaccctttatgtcttcgggactgtgaccaaggtcaccgtcctaggtcagcccaaggcccaaccccactgtcactctcgttccccg

SEQ ID NO: 597224 - DNA, 510 bp, Homo sapiens
  misc_feature: HIJSMM301CBGW8.5.27.C05.1.454.light.4.raw
atcagacacgcacgaccggtgctcgatttagacgcgatcgaagggtttgggagggtttgggaacctatgaacattctgtaggggccactttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagccaaggccaacccactgtcactctgttcccaccctcctccgtcgtctgat

SEQ ID NO: 597225 - DNA, 462 bp, Homo sapiens
  misc_feature: HIJSMM301CUL3K.11.86.H09.1.454.light.4.raw
cgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcagcatgggatgacaccctgaatggtccttgtgttggttttcggcggagggaccaagctgaccgtcctaggttcagcccaaggctgccccctcggtcactctgttcccaccctcctcgtatctctcg

SEQ ID NO: 597226 - DNA, 521 bp, Homo sapiens; identical to SEQ ID NO: 538715
  misc_feature: HIJSMM301CVLBU.27.23.C01.1.454.light.4.raw

SEQ ID NO: 597227 - DNA, 494 bp, Homo sapiens; identical to SEQ ID NO: 535478
  misc_feature: HIJSMM301D8YTU.10.79.H02.1.454.light.4.raw

SEQ ID NO: 597228 - DNA, 501 bp, Homo sapiens; identical to SEQ ID NO: 535873
  misc_feature: HIJSMM301AURQ4.17.27.C05.1.454.light.4.raw

SEQ ID NO: 597229 - DNA, 486 bp, Homo sapiens; identical to SEQ ID NO: 535917
  misc_feature: HIJSMM301C3Y6X.3.10.A10.1.454.light.4.raw

SEQ ID NO: 597230 - DNA, 483 bp, Homo sapiens; identical to SEQ ID NO: 535413
  misc_feature: HIJSMM301DE493.26.78.H01.1.454.light.4.raw

SEQ ID NO: 597231 - DNA, 517 bp, Homo sapiens
  misc_feature: HIJSMM301CXHOJ.15.34.D01.1.454.light.4.raw
tctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggcccagcctccacgcacgctcatctacagtacaaacactcgctcttccggggtccctgatcgcttctctggctccatccttgggaacaagctgccctcaccatcacgggggcccaggcagacgatgaatgtgattatcactgcgtcctttatgtgggcgtggcatttgggtgttcggcggaggggaccaaacgtgaccgtcctaggtcagcccaaggctgccccctcggtcactctccg

SEQ ID NO: 597232 - DNA, 484 bp, Homo sapiens; identical to SEQ ID NO: 535400
  misc_feature: HIJSMM301BSF0E.46.26.C04.1.454.light.4.raw

SEQ ID NO: 597233 - DNA, 497 bp, Homo sapiens
  misc_feature: HIJSMM301ASSDD.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgtcttcgctggactgccagataggttcagtggcagcgggtcagggacagtattttacactagaaaatcagccgggtggaggctgaggacgttggaattttattactgtatgacaaggtatagagtcttcctccgtcggttcgccgaaggaccgaaggtgaactacaaacgaacta

SEQ ID NO: 597234 - DNA, 454 bp, Homo sapiens; identical to SEQ ID NO: 534964
  misc_feature: HIJSMM301D11VS.19.86.H09.1.454.light.4.raw

SEQ ID NO: 597235 - DNA, 484 bp, Homo sapiens
  misc_feature: HIJSMM301CPFZ0.3.88.H11.1.454.light.4.raw
agacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccactttgcaaactggggtcccatccaggttcagcggcaggggatctgggacagatttcactctcaccatcagcagcctgcagcctgaagattttgcaacttactattgtcaacaggctaacagtttcccttaatcttcggccaagggacacgactggagattaaacgaactgtggctgcacca

SEQ ID NO: 597236 - DNA, 462 bp, Homo sapiens
  misc_feature: HIJSMM301CRUWK.11.70.G04.1.454.light.4.raw
cgagagataccacgaccggtgctcgatttagtgtagtgtgaagggaaaggggcagaagtctctctcagtcaggacacagcatggacatgagggtctctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgttgcaacttattactgtcaaagaatagcgctgccccgctcagtttcggcggagggaccaaggtggagac

SEQ ID NO: 597237 - DNA, 505 bp, Homo sapiens; identical to SEQ ID NO: 574237
  misc_feature: HIJSMM301EEZL0.19.78.H01.1.454.light.4.raw

SEQ ID NO: 597238 - DNA, 492 bp, Homo sapiens
  misc_feature: HIJSMM301AGATQ.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcaggtgggtctgggacagacttcactctcaccatcagcagactggagcctgaagtattttgcagtctattactgtcagcagtatggtcaccgtcccaagtaacttttggccgaggggaccaagctggagatacaaacgaactgtggctgcaccat

SEQ ID NO: 597239 - DNA, 442 bp, Homo sapiens
  misc_feature: HIJSMM301DF9MN.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtccactctgttcccgccctcctcgtatctctcg

SEQ ID NO: 597240 - DNA, 492 bp, Homo sapiens
  misc_feature: HIJSMM301DE7BA.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggcagtttatactgtcagcagtattatactactcctctgacttcggccaagggaccaaggtggagatcaaacgaactgtggctgcaccat

SEQ ID NO: 597241 - DNA, 444 bp, Homo sapiens; identical to SEQ ID NO: 535856
  misc_feature: HIJSMM301DL7LU.9.9.A09.1.454.light.4.raw

SEQ ID NO: 597242 - DNA, 495 bp, Homo sapiens
  misc_feature: HIJSMM301A9A8E.26.23.C01.1.454.light.4.raw
  modified_base (487)..(487): a, c, t, g, unknown or other
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcggtccacggggaccgaacggtaggaaggtctaagcgaactgtggctgcnccatctgt

SEQ ID NO: 597243 - DNA, 486 bp, Homo sapiens
  misc_feature: HIJSMM301AXMNJ.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccagggggccaagctggagatcaaacgaactgtggctgcaccat

SEQ ID NO: 597244 - DNA, 500 bp, Homo sapiens
  misc_feature: HIJSMM301BI0NY.17.86.H09.1.454.light.4.raw
  modified_base (493)..(493): a, c, t, g, unknown or other
cgtagactagcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactgtaaccagcagtgaccttagtgcttataactatgtctcctggtaccaacagcacccaggcaaggtccccaaagccatgatttatgaggtcagtaatcggccctcaggggtttctaatcgcttctctggctccaagtctggcaacacggcctccctcaccatctctggactccagcctgaggacgaggctgattattactgcatctcatttgtaagcagtagccttgtgttattcggcggagggaccaagctgaccgtcctgggtcagcccaaggccnccctccc

SEQ ID NO: 597245 - DNA, 493 bp, Homo sapiens
  misc_feature: HIJSMM301ASDG2.43.72.G06.1.454.light.4.raw
tgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagtcagcatcacctgctctggagataaattgggggataaatatgcctcctggtatcagcagaagccaggcgagtcccctgtgttggtcatctatcaagatgacaaacggccctcagggatccctgagcgattctctggctccaactctgggaacacagccactctgaccatcagcgggacccaggctatggatgaggctgactttactgtcaggcgtgggacaccaacactgtggtttcggcggaggaccaagctgaccgtcctaggtcagcccaaggctcgccccctcggtccta

SEQ ID NO: 597246 - DNA, 495 bp, Homo sapiens; identical to SEQ ID NO: 594980
  misc_feature: HIJSMM301AGLZX.52.38.D05.1.454.light.4.raw

SEQ ID NO: 597247 - DNA, 474 bp, Homo sapiens; identical to SEQ ID NO: 561309
  misc_feature: HIJSMM301C0S7F.5.12.B01.1.454.light.4.raw

SEQ ID NO: 597248 - DNA, 524 bp, Homo sapiens
  misc_feature: HIJSMM301A10XS.8.33.C11.1.454.light.4.raw
ctcgcgtgtccacgaccggtgctcgatttagagtgagctcgttgggtttggggggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggcccgactttcggcccgtcgggaccgaacggtaggaggatacaaacgaaacctagtggcgtgcgaccactctgtctttctatt

SEQ ID NO: 597249 - DNA, 491 bp, Homo sapiens; identical to SEQ ID NO: 536211
  misc_feature: HIJSMM301D2QCS.16.53.E09.1.454.light.4.raw

SEQ ID NO: 597250 - DNA, 514 bp, Homo sapiens; identical to SEQ ID NO: 540552
  misc_feature: HIJSMM301AR54T.16.66.F11.1.454.light.4.raw

SEQ ID NO: 597251 - DNA, 454 bp, Homo sapiens; identical to SEQ ID NO: 536347
  misc_feature: HIJSMM301ED9DV.19.86.H09.1.454.light.4.raw

SEQ ID NO: 597252 - DNA, 486 bp, Homo sapiens
  misc_feature: HIJSMM301C094N.14.53.E09.1.454.light.4.raw
cgtctagtaccacgaccggtgctcgatttagagagagtgtgttgggtttggggggggagcctagctgtgctgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgtctttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggaggaccaagctgaccgtcta

SEQ ID NO: 597253 - DNA, 441 bp, Homo sapiens; identical to SEQ ID NO: 550529
  misc_feature: HIJSMM301CZUKJ.41.9.A09.1.454.light.4.raw

SEQ ID NO: 597254 - DNA, 501 bp, Homo sapiens; identical to SEQ ID NO: 573085
  misc_feature: HIJSMM301CK8J3.48.78.H01.1.454.light.4.raw

SEQ ID NO: 597255 - DNA, 479 bp, Homo sapiens; identical to SEQ ID NO: 537141
  misc_feature: HIJSMM301BKPID.7.76.G10.1.454.light.4.raw

SEQ ID NO: 597256 - DNA, 447 bp, Homo sapiens; identical to SEQ ID NO: 535020
  misc_feature: HIJSMM301A9E65.18.9.A09.1.454.light.4.raw

SEQ ID NO: 597257 - DNA, 486 bp, Homo sapiens; identical to SEQ ID NO: 535385
  misc_feature: HIJSMM301EXE9F.19.71.G05.1.454.light.4.raw

SEQ ID NO: 597258 - DNA, 502 bp, Homo sapiens
  misc_feature: HIJSMM301C5GRY.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggcccaaacccca

SEQ ID NO: 597259 - DNA, 493 bp, Homo sapiens; identical to SEQ ID NO: 558967
  misc_feature: HIJSMM301CXUXJ.11.59.F04.1.454.light.4.raw

SEQ ID NO: 597260 - DNA, 488 bp, Homo sapiens; identical to SEQ ID NO: 535568
  misc_feature: HIJSMM301EPMAO.21.4.A04.1.454.light.4.raw

SEQ ID NO: 597261 - DNA, 515 bp, Homo sapiens
  misc_feature: HIJSMM301DH6NB.19.72.G06.1.454.light.4.raw
tactctcgtgcacgaccggtgctcgatttagctacgactgcaagggaaaggggggggtcgcaagaggcagcgctctcgggacgtctccaccatggcctgggctctgctgctcctcactctcctcactcaggacacagggtcctgggcccagtctgccctgactcagcctgcctccgtgtctgagtctcttggacagtcgatcaccatctcctccactgggaccggtcgtgatgttgggacttatacccttgtctcctggtaccaacaataccccggcaaagcccccaaactcctgatttatgaggctcataagcggccctcaggggtttctgagcgcttctctggctccagggctgacaacacggcctacctgacgatctctgggctccaggctgaggacgaggctgactattattgctgcgcatacgcaggaagtagcacatgggtgtggcggcggagggaccaaggtcgaccgtcctgggtcaggcccaaggctcgccccctcggtcactccg

SEQ ID NO: 597262 - DNA, 476 bp, Homo sapiens; identical to SEQ ID NO: 538026
  misc_feature: HIJSMM301B18XG.13.76.G10.1.454.light.4.raw

SEQ ID NO: 597263 - DNA, 498 bp, Homo sapiens
  misc_feature: HIJSMM301D9HQB.5.86.H09.1.454.light.4.raw
atcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtctaggtcagccaaggctgcccctc

SEQ ID NO: 597264 - DNA, 504 bp, Homo sapiens; identical to SEQ ID NO: 535561
  misc_feature: HIJSMM301DG6W5.4.57.F02.1.454.light.4.raw

SEQ ID NO: 597265 - DNA, 462 bp, Homo sapiens
  misc_feature: HIJSMM301A64PC.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccaccgaggttcagtggaagtggatctgggacagactttactctcaccatcagcagcctgcagcctgaagatattgcaacatattactgtcaacagtatgatcgtctcctcaatttcggccctgggaccagagtggacatgaaacga

SEQ ID NO: 597266 - DNA, 498 bp, Homo sapiens
  misc_feature: HIJSMM301AU4FN.16.46.E02.1.454.light.4.raw
tgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgatttattactgcagcttatatacaggcaacaatacttttgtcttcggaactgggaccaaggtcaccgtcctaggtcagcccaaggccaaccccactgtcactctgttcccaccctcctcgagtagtaca

SEQ ID NO: 597267 - DNA, 516 bp, Homo sapiens
  misc_feature: HIJSMM301CQ85F.43.23.C01.1.454.light.4.raw
tgtgagtagtcacgaccggtgctcgatttagtacacgtgattagggattggggggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcgggggcaaagctgccctgacactgtcaggtgtgcagcctgaggacgaggctgactattactgcctgctcatatatggtggcgcgtgggtgttcggcggagggaccaagctgaccgtcctgggtcagcccaaggctgccccctcggtcactctgttcccaccctcctca

SEQ ID NO: 597268 - DNA, 377 bp, Homo sapiens; identical to SEQ ID NO: 536071
  misc_feature: HIJSMM301C6DR4.40.9.A09.1.454.light.4.raw

SEQ ID NO: 597269 - DNA, 480 bp, Homo sapiens
  misc_feature: HIJSMM301BCYT4.26.72.G06.1.454.light.4.raw
agactatactcacgaccggtgctcgatttagctacgactgcaagggaaagggtgagatccctcactgtggctcactttcagcggagggaccacggtggagatcacacgtaagtgcactttcctaatgctttttcttataaggttttaagtttggagcgtttttgtgtttgagatgttagctcaggtcaattccaaagagtaccagattctttcaaaaagtcagatgagtaagggatagaaaattagttcaccttaaggaacagccaagcgctagccagttaagtgaggcatctcaattgcaaggttttctctgcatcggtcaggttagtgatattaacagcgaaaagagtatttttgttaaggggaaagtaatgaagttaacactgtggatcaccttcggccaagggacacgactggagattaaacgaactgtggctgcaccatctgtcttcatccttcccgccatctgaagtatagtct

SEQ ID NO: 597270 - DNA, 485 bp, Homo sapiens
  misc_feature: HIJSMM301D73MH.49.37.D04.1.454.light.4.raw
agtcgagagacacgaccggtgctcgatttagtagcatactgttgggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccagggtggaggatcaaacg

SEQ ID NO: 597271 - DNA, 496 bp, Homo sapiens
  misc_feature: HIJSMM301AUIRU.3.33.C11.1.454.light.4.raw
  modified_base (488)..(488): a, c, t, g, unknown or other
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggtggagggaccaagctgaccgtcctaggtcagcccaaggctgccccctcggtcactctgttcccaccctcctcgngtgcgtct

SEQ ID NO: 597272 - DNA, 477 bp, Homo sapiens
  misc_feature: HIJSMM301ERBD4.5.70.G04.1.454.light.4.raw
atcagacacgcacgaccggtgctcgatttagtgtagtgtgaagggaaagggggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctgaagattttgcaacttactttgtcaacaggctcagatttcccgctcactttcggcggagggaccaaggtggagatcaaacgaactgtggctgca

SEQ ID NO: 597273 - DNA, 516 bp, Homo sapiens
  misc_feature: HIJSMM301CQVBR.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccgacttcggcccgtcggccgaaacgtaggagtagtcaacgaaactagtaggtcgtgcaccactctcgtctt

SEQ ID NO: 597274 - DNA, 502 bp, Homo sapiens; identical to SEQ ID NO: 538706
  misc_feature: HIJSMM301DDTYP.19.10.A10.1.454.light.4.raw

SEQ ID NO: 597275 - DNA, 461 bp, Homo sapiens; identical to SEQ ID NO: 561362
  misc_feature: HIJSMM301CUR6E.52.8.A08.1.454.light.4.raw

SEQ ID NO: 597276 - DNA, 484 bp, Homo sapiens; identical to SEQ ID NO: 535400
  misc_feature: HIJSMM301AH4CA.46.26.C04.1.454.light.4.raw

SEQ ID NO: 597277 - DNA, 494 bp, Homo sapiens; identical to SEQ ID NO: 536477
  misc_feature: HIJSMM301EVG0C.22.5.A05.1.454.light.4.raw

SEQ ID NO: 597278 - DNA, 484 bp, Homo sapiens; identical to SEQ ID NO: 535240
  misc_feature: HIJSMM301DTZG7.47.60.F05.1.454.light.4.raw

SEQ ID NO: 597279 - DNA, 482 bp, Homo sapiens
  misc_feature: HIJSMM301BDC4N.47.48.E04.1.454.light.4.raw
agctcacgtacacgaccggtgctcgatttagagagcgtcacagagagaaggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggccagggaccaaggtggaatcaaacgaactagtggctgcaccta

SEQ ID NO: 597280 - DNA, 486 bp, Homo sapiens; identical to SEQ ID NO: 535043
  misc_feature: HIJSMM301EL7RD.46.35.D02.1.454.light.4.raw

SEQ ID NO: 597281 - DNA, 512 bp, Homo sapiens
  misc_feature: HIJSMM301CCHP1.7.34.D01.1.454.light.4.raw
cgtgtctctacacgaccggtgctcgatttagatcgtctgtgttgggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgcttgctcatatacaggggacagcattatttgggtgttcggcggagggaccaagctgaccgtcctgcgtcagcccaaggctgccccctggtccact

SEQ ID NO: 597282 - DNA, 423 bp, Homo sapiens
  misc_feature: HIJSMM301D8H1J.41.15.B04.1.454.light.4.raw
tctatactatcacgaccggtgctcgatttagacagtatatatccgcggcacgaccggtgctcgatttagtctagcgactttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggtcggagggaccaaggtggagatcaaacgaactgtggctgcaccatctgtcttcatcttcccgtccatctgaatagtataga

SEQ ID NO: 597283 - DNA, 490 bp, Homo sapiens; identical to SEQ ID NO: 535234
  misc_feature: HIJSMM301E0TLN.17.21.B10.1.454.light.4.raw

SEQ ID NO: 597284 - DNA, 499 bp, Homo sapiens; identical to SEQ ID NO: 537739
  misc_feature: HIJSMM301BVBVI.12.86.H09.1.454.light.4.raw

SEQ ID NO: 597285 - DNA, 354 bp, Homo sapiens; identical to SEQ ID NO: 535026
  misc_feature: HIJSMM301DN59Q.19.22.B11.1.454.light.4.raw

SEQ ID NO: 597286 - DNA, 517 bp, Homo sapiens
  misc_feature: HIJSMM301DH9KC.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgaccgttcgccggggaccgaccgtcggaaagtacaaaccgaaactagtggcgtgcaccatctcgtcttt

SEQ ID NO: 597287 - DNA, 495 bp, Homo sapiens; identical to SEQ ID NO: 550692
  misc_feature: HIJSMM301B20N3.3.33.C11.1.454.light.4.raw

SEQ ID NO: 597288 - DNA, 479 bp, Homo sapiens; identical to SEQ ID NO: 536050
  misc_feature: HIJSMM301EJET6.5.73.G07.1.454.light.4.raw

SEQ ID NO: 597289 - DNA, 485 bp, Homo sapiens; identical to SEQ ID NO: 536040
  misc_feature: HIJSMM301BX5JM.15.1.A01.1.454.light.4.raw

SEQ ID NO: 597290 - DNA, 486 bp, Homo sapiens; identical to SEQ ID NO: 535043
  misc_feature: HIJSMM301E3UR9.46.35.D02.1.454.light.4.raw

SEQ ID NO: 597291 - DNA, 519 bp, Homo sapiens
  misc_feature: HIJSMM301B2PIO.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggcccaaccccactgtcactctcg

SEQ ID NO: 597292 - DNA, 484 bp, Homo sapiens; identical to SEQ ID NO: 567195
  misc_feature: HIJSMM301DGT9J.47.46.E02.1.454.light.4.raw
  modified_base (459)..(459): a, c, t, g, unknown or other

SEQ ID NO: 597293 - DNA, 498 bp, Homo sapiens; identical to SEQ ID NO: 547944
  misc_feature: HIJSMM301BZ22T.41.53.E09.1.454.light.4.raw

SEQ ID NO: 597294 - DNA, 444 bp, Homo sapiens; identical to SEQ ID NO: 535192
  misc_feature: HIJSMM301B4F17.5.9.A09.1.454.light.4.raw

SEQ ID NO: 597295 - DNA, 521 bp, Homo sapiens; identical to SEQ ID NO: 538715
  misc_feature: HIJSMM301BTZW4.27.23.C01.1.454.light.4.raw

SEQ ID NO: 597296 - DNA, 494 bp, Homo sapiens; identical to SEQ ID NO: 534992
  misc_feature: HIJSMM301A6IZ6.9.1.A01.1.454.light.4.raw

SEQ ID NO: 597297 - DNA, 504 bp, Homo sapiens; identical to SEQ ID NO: 567466
  misc_feature: HIJSMM301EDKSG.10.82.H05.1.454.light.4.raw

SEQ ID NO: 597298 - DNA, 485 bp, Homo sapiens; identical to SEQ ID NO: 535985
  misc_feature: HIJSMM301DCXNO.15.1.A01.1.454.light.4.raw

SEQ ID NO: 597299 - DNA, 476 bp, Homo sapiens
  misc_feature: HIJSMM301BAX84.40.1.A01.1.454.light.4.raw
tctagcgactcacgaccggtgctcgatttagacgtctcatcagggggagtcagtcccaaccaggacacagcatggacatgagggtccctgctcagctcctggggctcctgctgctctggctctcaggtgccagatgtgacatccagctgacccagtctccatcctccctgtctgcatctgttggagacagagtcaccatcacttgccaggcgagtcaggacattagtaaatatttgaattggtatcaacaaaaaccagggaaagcccctaagctcctgatctacgatgcatctaagttggaaacaggggtctcatcaaggttcagtggaagtggatctgggacagatcctactttcaccatcagcagcctgcagccagaagatattgcgacatatttctgttcaggtgtatgaaagtctccctgttttggtccaggggaccaaggtggagatcaaacgaactagtggctgcaccat

SEQ ID NO: 597300 - DNA, 501 bp, Homo sapiens
  misc_feature: HIJSMM301DN0OB.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgacgtcctgggtcagccaaggctgcccctcggtcactctgttccgccctcctctacgtcgtat

SEQ ID NO: 597301 - DNA, 501 bp, Homo sapiens; identical to SEQ ID NO: 536142
  misc_feature: HIJSMM301DFN16.15.1.A01.1.454.light.4.raw

SEQ ID NO: 597302 - DNA, 495 bp, Homo sapiens
  misc_feature: HIJSMM301ARON8.43.29.C07.1.454.light.4.raw
tgtgagtagtcacgaccggtgctcgatttagagtgctacgaagggaaaggggggagtcagacccactcaggacacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtggggtcccatcaagattcagcggtagtggatctgggacagaattcactctcaccgtcagcagcctgcagcctgaagattttgcaacttattactgtcaacagtttaataactaccctctcactttcggaggagggaccagggtggagatcaaacgaactagtggctgcaccatctgtcttcta

SEQ ID NO: 597303 - DNA, 444 bp, Homo sapiens; identical to SEQ ID NO: 535411
  misc_feature: HIJSMM301DJVA6.8.73.G07.1.454.light.4.raw

SEQ ID NO: 597304 - DNA, 494 bp, Homo sapiens
  misc_feature: HIJSMM301AO42O.43.53.E09.1.454.light.4.raw
tgtgagtagtcacgaccggtgctcgatttagagagagtgtgttgggtttggggtggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaatcatgatttatgagggcactaagcggccctcaggggtttctgatcgcttctctggctccaagtctggcaacacggcctccctgacaatctctgggctccaggctgaggacgaggctgattatattgctgctcatatgcaggtagttacacttatgtcttcggaattgggacgacggtcaccgtcctaggtcagcccaaggccaa

SEQ ID NO: 597305 - DNA, 482 bp, Homo sapiens; identical to SEQ ID NO: 535796
  misc_feature: HIJSMM301AHAOE.51.64.F09.1.454.light.4.raw

SEQ ID NO: 597306 - DNA, 458 bp, Homo sapiens
  misc_feature: HIJSMM301BQNMP.49.83.H06.1.454.light.4.raw
agtcgagagacacgaccggtgctcgatttagatcacgtgcgtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggataaatatgctggctggtatcagcagaagccaggccagtcccctgtgttggtcatctatcaagataccaagcggccctcagggatccctgagcgattctctggctccaactctgggaacacagccactctgaccatcagcgggactcaggctatcgatgaggctgactattactgtcaggcgtgggacagccgcactggggtattcgggcggagggaccaagctgaccgt

SEQ ID NO: 597307 - DNA, 523 bp, Homo sapiens; identical to SEQ ID NO: 588159
  misc_feature: HIJSMM301E0YCO.52.62.F07.1.454.light.4.raw

SEQ ID NO: 597308 - DNA, 480 bp, Homo sapiens
  misc_feature: HIJSMM301AHGWK.12.10.A10.1.454.light.4.raw
atacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaaagcccctaacgtcctgatctatggtgcatccactttgcatagtggggtcccatcaaggttcagcggcagtggatctgggacagaattcactctcacaatcaccagcctgcagcctgaagattttgcaacttattactgtcaacaggttatatttacctcgtattttcggcctcgggaccacagtagatatacaaacgaactgtggctgcaccat

SEQ ID NO: 597309 - DNA, 496 bp, Homo sapiens; identical to SEQ ID NO: 538625
  misc_feature: HIJSMM301CBVQJ.2.49.E05.1.454.light.4.raw

SEQ ID NO: 597310 - DNA, 500 bp, Homo sapiens
  misc_feature: HIJSMM301CSTTB.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtccactctcgttccccgccctcctccgagtgcgtct

SEQ ID NO: 597311 - DNA, 476 bp, Homo sapiens
  misc_feature: HIJSMM301DEDBX.12.1.A01.1.454.light.4.raw
atacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgcaacttattactgtcaacagagtaacagttaccctcccactttcggcggaggaccaaggtggagatcaaacgaactgtggctgcaccatctgtt

SEQ ID NO: 597312 - DNA, 473 bp, Homo sapiens; identical to SEQ ID NO: 541215
  misc_feature: HIJSMM301EMKQJ.13.48.E04.1.454.light.4.raw

SEQ ID NO: 597313 - DNA, 486 bp, Homo sapiens
  misc_feature: HIJSMM301BSVIF.14.55.E11.1.454.light.4.raw
cgtctagtaccacgaccggtgctcgatttagcactcgcacgttgggtttggggagtctcagtcaggacacagcatggacatgagggtccccgctcagctcatggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtggctgcaccatctgtctt

SEQ ID NO: 597314 - DNA, 466 bp, Homo sapiens
  misc_feature: HIJSMM301CNJLS.12.39.D06.1.454.light.4.raw
atacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggaggggaatggggtgagaaagatccagtgtagagattgtgatgacccagactccagtctccttgtctctcacccctggagagcaggcctccatgtcctgcaggtctagtctgcgcctcctgcatagtgacggatgctcccttttgtattggtttctgcagagaggcaggccagtctccacaactcctgatctatgaagttgccacccggctctctggagtgccagatatgttcagtggctgcgggtcaggcacagatctcacactgaaaaaacagccgggtggagagtgaccatgttggaacttatta

SEQ ID NO: 597315 - DNA, 519 bp, Homo sapiens
  misc_feature: HIJSMM301A8VQM.12.71.G05.1.454.light.4.raw
atacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcactttgggtgttcggcggcgggaccaaagtgaccgtcctaagtcagcccaaggctgccccctggtcactctgttcccacct

SEQ ID NO: 597316 - DNA, 469 bp, Homo sapiens
  misc_feature: HIJSMM301ADUJQ.4.75.G09.1.454.light.4.raw
agcactgtagcacgaccggtgctcgatttagtatagacatcgagggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataaattgggggataagtatgtttgttggtatcagcagaagccaggccagtcccctgtgctggtcatctattatgataccaagcggccctcagggatccctgagcgattctctggctccaactctgggaacacagccactctgaccatcagcgggacccaggctatggatgaggctgactattactgtcaggcgtgggacagcagcactccctatgtcttcggcactgggaccaaggtcaccgtcctaggtcag

SEQ ID NO: 597317 - DNA, 444 bp, Homo sapiens; identical to SEQ ID NO: 535027
  misc_feature: HIJSMM301C27PJ.8.73.G07.1.454.light.4.raw

SEQ ID NO: 597318 - DNA, 493 bp, Homo sapiens
  misc_feature: HIJSMM301DBZ7K.15.59.F04.1.454.light.4.raw
tctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtgctggcatttcggtcttcggcggagggaccaagctgaccgtcctaggtcagcccaaggctgccccctggtcactctgttcccaccctcctcgctacgtaga

SEQ ID NO: 597319 - DNA, 478 bp, Homo sapiens
  misc_feature: HIJSMM301BXUT0.52.26.C04.1.454.light.4.raw
cgcagtacgacacgaccggtgctcgatttagtctagcgactttgggtttggggctgggcctcaggaagcagcatcggaggtgcctcagccatggcatggatccctctcttcctcggcgtccttgcttactgcacaggatccgtggcctcctatgagctgactcagccacactcagtgtccgtgtccccaggacagacagccagcatcacctgctctggagatgaattggggaataaatttgcttgctggtatcaccagaagccaggccagtcccctgtcctggtcatctatcaagatgtcaagcggccctcagggatccctgagcgattctctggctccaactctgggaacacagccactctgaccatcagcgggacccaggctatggatgaggctgactattactgtcaggcgtgggacagcaacactgtggtattcggcggagggaccaagctgaccgtcctaggtcagcccaagg

SEQ ID NO: 597320 - DNA, 484 bp, Homo sapiens; identical to SEQ ID NO: 535400
  misc_feature: HIJSMM301A9R1R.46.26.C04.1.454.light.4.raw

SEQ ID NO: 597321 - DNA, 489 bp, Homo sapiens; identical to SEQ ID NO: 542280
  misc_feature: HIJSMM301D4LWS.15.49.E05.1.454.light.4.raw

SEQ ID NO: 597322 - DNA, 507 bp, Homo sapiens; identical to SEQ ID NO: 558669
  misc_feature: HIJSMM301DHLQW.21.22.B11.1.454.light.4.raw

SEQ ID NO: 597323 - DNA, 506 bp, Homo sapiens; identical to SEQ ID NO: 537290
  misc_feature: HIJSMM301DD9TA.13.11.A11.1.454.light.4.raw

SEQ ID NO: 597324 - DNA, 516 bp, Homo sapiens
  misc_feature: HIJSMM301A9WLA.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccaacggacgaacggtaggaaggtacaaacgaaactagtaggctgcaccactctgtcttctactcttcccgtcccact

SEQ ID NO: 597325 - DNA, 490 bp, Homo sapiens; identical to SEQ ID NO: 535234
  misc_feature: HIJSMM301ALP3B.17.21.B10.1.454.light.4.raw

SEQ ID NO: 597326 - DNA, 503 bp, Homo sapiens
  misc_feature: HIJSMM301CKZCV.19.85.H08.1.454.light.4.raw
tactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctggacaccagcctcgctgcttggcttttcggcggagggaccaagctgaccgtcctgggtcagcccaaggctcgccccctcggt

SEQ ID NO: 597327 - DNA, 521 bp, Homo sapiens
  misc_feature: HIJSMM301DKL2I.9.38.D05.1.454.light.4.raw
tgatacgtctcacgaccggtgctcgatttagtatctgatagttgggtttggggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaagcccccaaactcttgctttatgatgtcagttatcggccctcaggagtttctgatcgcttctctggctccaagtctggcaccacggcctccctgaccatctctgggctccaggctgaggacgaggctgattatttctgcagctcaaaaagagtagccctctcgtggttttcggcgggggaccgaaggtgaccgtcctaagtcagcccaaggctgccccctcggtcactctgttcccaccctcctc

SEQ ID NO: 597328 - DNA, 503 bp, Homo sapiens
  misc_feature: HIJSMM301A3SB5.51.49.E05.1.454.light.4.raw
cgatcgtatacacgaccggtgctcgatttagagcgactagcaacacacaaagggggaggaactgctcagttaggagccagacggaaccatggaagccccagcgcagcttctcttcctcctgctactctggctcccagataccattggagagatagtgctgacgcagtctccagccaccctgtctgtgtctccaggggagagagtcaccctctcctgcagggcctctgagaatatagatatctacttggtctggtaccagcaaaaacctggccagcctcccaggctcctcgtccatagtgcctccgccagggccgctggtgtcccagccaggttccgaggcagtcggtctgggacagagttcactctcaccattaccaacctgcagtctgaagattttggactttattactgtcagcagtataatgactggcctaggacgttcggccaagggaccgagggtggaaagtacaagacgaactagtggctgcaccatctgtcttcta

SEQ ID NO: 597329 - DNA, 492 bp, Homo sapiens; identical to SEQ ID NO: 534967
  misc_feature: HIJSMM301CL9L9.47.64.F09.1.454.light.4.raw

SEQ ID NO: 597330 - DNA, 500 bp, Homo sapiens
  misc_feature: HIJSMM301CSND5.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaaccgtcctaggtcagcccaaggccaaccca

SEQ ID NO: 597331 - DNA, 504 bp, Homo sapiens; identical to SEQ ID NO: 556255
  misc_feature: HIJSMM301EIRFX.48.26.C04.1.454.light.4.raw

SEQ ID NO: 597332 - DNA, 492 bp, Homo sapiens; identical to SEQ ID NO: 538320
  misc_feature: HIJSMM301A86SP.43.25.C03.1.454.light.4.raw

SEQ ID NO: 597333 - DNA, 490 bp, Homo sapiens
  misc_feature: HIJSMM301EDWEK.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagttttattattgtcaacaatattattatacttcgtggacgttcggccaagggacccaaggtggatatcagacgaaa

SEQ ID NO: 597334 - DNA, 480 bp, Homo sapiens
  misc_feature: HIJSMM301D2744.8.53.E09.1.454.light.4.raw
ctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcagggtctctgaccgattctctgcctccaagtctggcacttctgcctccctggtcatatctggtctccagggtgaggatgaggctgattattactgccactcctatgacaacagcctgagtatttggctgttcggcggtcgggacc

SEQ ID NO: 597335 - DNA, 507 bp, Homo sapiens; identical to SEQ ID NO: 564521
  misc_feature: HIJSMM301BMLTB.21.87.H10.1.454.light.4.raw

SEQ ID NO: 597336 - DNA, 503 bp, Homo sapiens; identical to SEQ ID NO: 548067
  misc_feature: HIJSMM301BNRWG.9.53.E09.1.454.light.4.raw

SEQ ID NO: 597337 - DNA, 484 bp, Homo sapiens; identical to SEQ ID NO: 535400
  misc_feature: HIJSMM301B7KKR.46.26.C04.1.454.light.4.raw

SEQ ID NO: 597338 - DNA, 511 bp, Homo sapiens
  misc_feature: HIJSMM301ADBT3.13.55.E11.1.454.light.4.raw
tcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcaccatcacttgccgggcaagtcagagcattaccaactatttgaattggtatcaacaaaaaccagggagagcccctcacctccttatctatggtgcatccaccttacaaagtggggtcccatcaaggttcagtggcactggatctgggacagatttcactctcaccatcagcagtctgcaacctgaagattttgcaacttattactgtcaacagagtttcagtacgcggacgttcggccgaagggaccgaaggtaggaaagtacaaacgaactagtaggcgtgtcaccactctcgtcttctatcttccccg

SEQ ID NO: 597339 - DNA, 491 bp, Homo sapiens
  misc_feature: HIJSMM301BX3MI.19.83.H06.1.454.light.4.raw
tactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactgaaaatcaacagagtggaggctgaggatgttgggtttattactgcatgcaagctctacaaactccctcaacgttcggcggagggaccaaggtgagatcaaacgaactgtggctgcaccatctgtcttcta

SEQ ID NO: 597340 - DNA, 495 bp, Homo sapiens; identical to SEQ ID NO: 545183
  misc_feature: HIJSMM301D4STD.16.10.A10.1.454.light.4.raw

SEQ ID NO: 597341 - DNA, 495 bp, Homo sapiens; identical to SEQ ID NO: 588904
  misc_feature: HIJSMM301AZAXJ.11.81.H04.1.454.light.4.raw

SEQ ID NO: 597342 - DNA, 489 bp, Homo sapiens; identical to SEQ ID NO: 546040
  misc_feature: HIJSMM301EI23J.11.12.B01.1.454.light.4.raw

SEQ ID NO: 597343 - DNA, 486 bp, Homo sapiens
  misc_feature: HIJSMM301CURAI.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtccactctgttcccaccctcctcgctacgtaga

SEQ ID NO: 597344 - DNA, 508 bp, Homo sapiens
  misc_feature: HIJSMM301EEVKJ.51.38.D05.1.454.light.4.raw
cgatcgtatacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccagcctcggtgtcagtgtccccaggacagacggccaagatcccctgctctggagatgcattgccaaaacgatttgctttttggtaccaacagaagccaggccaggcccctataataattatatataaagacagtgagaggccctcagggatccctgagcgattctctggctccagctcagggacaacagccacgttgacgattagtggagtccaggcagaagacgaggctgactattactgtcaatcagcagacgacagtggtacttatggagtattcggcggagggaccaaggtgaccgtcctaggtcagcccaaggctgccccctggtcactctgttccccg

SEQ ID NO: 597345 - DNA, 491 bp, Homo sapiens
  misc_feature: HIJSMM301BL3NX.19.28.C06.1.454.light.4.raw
tactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggttaacagtgatggcagccacaccaagggggacgggatccctgatcgtttttcagggtccagctctggggctgagcgctacctcaccatctccagcctccagtctgaggatgaggctgactattactgtcagacctggggcactggttatgtggttttcggcggagggaccaagctgaccgtcctaggtcagcccaaggctgccccccg

SEQ ID NO: 597346 - DNA, 489 bp, Homo sapiens; identical to SEQ ID NO: 535139
  misc_feature: HIJSMM301CR27S.14.55.E11.1.454.light.4.raw

SEQ ID NO: 597347 - DNA, 488 bp, Homo sapiens
  misc_feature: HIJSMM301AE0G0.40.55.E11.1.454.light.4.raw
tctagcgactcacgaccggtgctcgatttagcactcgcacgttgggtttggggagagctgctcagttaggacccagagggaaccatggaaaccccagcgcagcttctcttcctcctgctactctggctcccagatagcaccggagaaatcgtgttgacgcagtctccaggcaccctgtctgtgtctccaggggaaagagccaccctctcctgcagggccagtcagagtgttagcagcagctacttagcctggtaccagcataaaccgggccaggctcccaggctcctcatctatggtgcatccagcagggccactggcatcccagacaggttcagttgcagtgggtctgggacagacttcactctcaccatcagcagactggagcctgaagattttgcaatttatttctgtcaacagcgtagcacctggccccgggtcaccttcggccaagggacacgactggacatgaaacgaactgtggctgcacc

SEQ ID NO: 597348 - DNA, 513 bp, Homo sapiens; identical to SEQ ID NO: 535244
  misc_feature: HIJSMM301A7ACQ.17.33.C11.1.454.light.4.raw

SEQ ID NO: 597349 - DNA, 492 bp, Homo sapiens
  misc_feature: HIJSMM301BVRRC.18.26.C04.1.454.light.4.raw
tacgagtatgcacgaccggtgctcgatttagtctagcgactttggggtttgggggggtcgagacccacgtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccaaggtagagatacaaagaactgtggctgcaccatctgtcttc

SEQ ID NO: 597350 - DNA, 460 bp, Homo sapiens; identical to SEQ ID NO: 536053
  misc_feature: HIJSMM301EN6M4.22.28.C06.1.454.light.4.raw

SEQ ID NO: 597351 - DNA, 511 bp, Homo sapiens
  misc_feature: HIJSMM301AT2LS.4.28.C06.1.454.light.4.raw
agcactgtagcacgaccggtgctcgatttagagctcacgtattgggtttggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgacttgggggagagatatgtttcctggtatctccagaggccaggccactcccctattctagtcatgtatcaaactacgaagcgcccctcaggggtccctgagcgcttttctggctccaagtctggggacacagccactctgactctctcggggcccaggccatcgatgagggagactattactgtcaggcgtgggacagcacaactgcagtcttcggcggagggaccagggtgaccgtcctgggtcagcccaaggctgccccctcggtcactctgttcccaccctcctccta

SEQ ID NO: 597352 - DNA, 447 bp, Homo sapiens; identical to SEQ ID NO: 535020
  misc_feature: HIJSMM301C8WR2.18.9.A09.1.454.light.4.raw

SEQ ID NO: 597353 - DNA, 507 bp, Homo sapiens
  misc_feature: HIJSMM301A638M.41.38.D05.1.454.light.4.raw
tctatactatcacgaccggtgctcgatttagtatctgatagttgggttggggaggagccagacccagtcaggacacagcatggacatgagggtccccgctcagctcctggggctcctgctgctctggttcccaggttccagatgcgacatccagatgacccagtctccatcttctgtgtctgcatctgtcggagacagagtcaccatcacttgtcgggcgagtcagggtattggcagctacttagtctggtatcaacaaaaaccaggaaagcccctaaactccttatttatggatcatccagtttacaaagtaggggtcccgatcaaggttcagcggcagtggatctgggacacatttcactctcactatcagcagcctgcagcctgaggattttgcgacttactattgtcaacaggctgacagtttccctctcactttcggtcggagggaccaaggttggtagaccaaacgaaacctagtggcgtgcgaccactctgttcttccta

SEQ ID NO: 597354 - DNA, 481 bp, Homo sapiens
  misc_feature: HIJSMM301B3IR0.52.4.A04.1.454.light.4.raw
cgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgttctggagataaaatggaggataaatatgtttcctggtatcgccagaagccaggccagtcgcctgtcctggtcatctatcacgataagaagcggccctcagggatccctgagcgattctctggctccaactctgggaacacagccactctgaccatcagccgggacccaggctatggatgaggctgactattactgtcagccgtggacagaagcactctggtgttcggcggagggaccaggctgaccgtcctaggtcagcccaaggctgccccccg

SEQ ID NO: 597355 - DNA, 521 bp, Homo sapiens; identical to SEQ ID NO: 539470
  misc_feature: HIJSMM301ALBUK.27.23.C01.1.454.light.4.raw

SEQ ID NO: 597356 - DNA, 496 bp, Homo sapiens; identical to SEQ ID NO: 556864
  misc_feature: HIJSMM301DQVG7.51.30.C08.1.454.light.4.raw

SEQ ID NO: 597357 - DNA, 521 bp, Homo sapiens; identical to SEQ ID NO: 538715
  misc_feature: HIJSMM301DVP49.27.23.C01.1.454.light.4.raw

SEQ ID NO: 597358 - DNA, 493 bp, Homo sapiens; identical to SEQ ID NO: 535047
  misc_feature: HIJSMM301CK0V7.16.53.E09.1.454.light.4.raw

SEQ ID NO: 597359 - DNA, 503 bp, Homo sapiens
  misc_feature: HIJSMM301DS20M.15.66.F11.1.454.light.4.raw
tctacgtagccacgaccggtgctcgatttagtcacgcgagaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcaggggtccctgatcgcttctctggctccaagtctggcgactcggcctccctgaccgtctctgggctccagcctgaagatgaggctgattatttctgcggctcatatggagacaattacagctttgtcttcggaagtgggaccaaggtcaccgtcctaagtcagcccaaggccaacccactgtcactctgttcccaccct

SEQ ID NO: 597360 - DNA, 498 bp, Homo sapiens
  misc_feature: HIJSMM301B44R4.52.61.F06.1.454.light.4.raw
cgcagtacgacacgaccggtgctcgatttagctacgctctaagggaaagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgcttctctggctccacctcagggacaatggtcacattgaccatcagtggagtccaggcagaagacgaggctgactatttctgtcaatcttcagacatcagtggtacttatgtcttcggaactgggaccaaggtcaccgtcctaggtcagcccaaggccaacccactgtcactctcg

SEQ ID NO: 597361 - DNA, 501 bp, Homo sapiens
  misc_feature: HIJSMM301DRKIN.9.53.E09.1.454.light.4.raw
tgatacgtctcacgaccggtgctcgatttagagagagtgtgttgggtttggggctttgcctgggctctgctgttcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctaggtcagcccaaggctgccccctcggtcactctgttcccgccctcctcagacgtatca

SEQ ID NO: 597362 - DNA, 484 bp, Homo sapiens; identical to SEQ ID NO: 536162
  misc_feature: HIJSMM301EAJRS.13.59.F04.1.454.light.4.raw

SEQ ID NO: 597363 - DNA, 503 bp, Homo sapiens; identical to SEQ ID NO: 553138
  misc_feature: HIJSMM301CBYZD.22.15.B04.1.454.light.4.raw

SEQ ID NO: 597364 - DNA, 484 bp, Homo sapiens; identical to SEQ ID NO: 538870
  misc_feature: HIJSMM301BWZNJ.11.76.G10.1.454.light.4.raw

SEQ ID NO: 597365 - DNA, 488 bp, Homo sapiens; identical to SEQ ID NO: 539884
  misc_feature: HIJSMM301B02ZT.7.85.H08.1.454.light.4.raw

SEQ ID NO: 597366 - DNA, 504 bp, Homo sapiens; identical to SEQ ID NO: 558529
  misc_feature: HIJSMM301BZF2C.41.35.D02.1.454.light.4.raw

SEQ ID NO: 597367 - DNA, 501 bp, Homo sapiens
  misc_feature: HIJSMM301CGGOY.17.10.A10.1.454.light.4.raw
cgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgcggcccccggacaggaggtcaccatctcttgctctggaaaccccccaatgttggattcaattatgtgtcctggtaccagcaactcccgggatcagcccccaaactcctcatatatgaagataataagcgaccctcaggggttcctgaccgattctctggctccaagtctggcacgtctgccaccctgggcatcaccgcgctccagactggggacgaggccgagtattctgcgcaacatgggattccagcctgacttctggggtgttcggcagtgggaccaagctgaccgtcctaggtcagcccaaggctccg

SEQ ID NO: 597368 - DNA, 478 bp, Homo sapiens
  misc_feature: HIJSMM301AP35W.8.85.H08.1.454.light.4.raw
ctcgcgtgtccacgaccggtgctcgatttagtatcactcagtcgcgggggagtcagtctcagtcaggacacagcatggacatgagggtccccgctcagctcctggggctcctgctactctggctccgaggtgccagatgtgacatccagatgacccagtctccatcctccctgtctgcatctgtcggagacagagtcaccatcacttgtcgggcaagtcagactataaataattatttaaattggtatcagcagaaaccagggaacgcccctaagctcctcatatattctgcattcactttgcaaagtggggtcccatcaaggttcagtggcagtggatctgggacagatttcactctcaccatccgcagtctgcaacctgaagattttgcaatttattactgtcaagagactcacaatggaggcacttttggccaggggaccaagctggagaggaaacgaaactgtggctgcaccat

SEQ ID NO: 597369 - DNA, 501 bp, Homo sapiens
  misc_feature: HIJSMM301CDPO3.52.86.H09.1.454.light.4.raw
  modified_base (464)..(464): a, c, t, g, unknown or other
cgcagtacgacacgaccggtgctcgatttagtgctatagacttgggtttgggggggtccaggaggcagaactctgggtgtctcaccacggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcaggggatccctgagcggattctctggctccaggtcagggacaacggtcacattggccatcagtggagtccaggcagaggacgaggctgactattattgtcaatcaacagacaccattggtacttatgtcttcggaactgcgaccaaggtcacgtccngggtcagcccaaggccaacccccactgtcactctgtt

SEQ ID NO: 597370 - DNA, 486 bp, Homo sapiens; identical to SEQ ID NO: 535385
  misc_feature: HIJSMM301EWEOH.19.71.G05.1.454.light.4.raw

SEQ ID NO: 597371 - DNA, 486 bp, Homo sapiens
  misc_feature: HIJSMM301BDRW2.47.70.G04.1.454.light.4.raw
  modified_base (475)..(475): a, c, t, g, unknown or other
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtacccgtacacttttggccaaggggccaaactggaccatcaaacgaactgtggntgcacatctgt

SEQ ID NO: 597372 - DNA, 520 bp, Homo sapiens; identical to SEQ ID NO: 539176
  misc_feature: HIJSMM301DYWFK.27.23.C01.1.454.light.4.raw

SEQ ID NO: 597373 - DNA, 506 bp, Homo sapiens
  misc_feature: HIJSMM301AK2S6.48.67.G01.1.454.light.4.raw
agtatacatacacgaccggtgctcgatttagagtatacatattggggtttggggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttctcaacagacagtagtggtgatcgagggctgttcggcggagggaccaagctggaccgtccctaagtcagcccaaggctcgccccctcggtcactctgtt

SEQ ID NO: 597374 - DNA, 494 bp, Homo sapiens; identical to SEQ ID NO: 534992
  misc_feature: HIJSMM301BDL4X.9.1.A01.1.454.light.4.raw

SEQ ID NO: 597375 - DNA, 500 bp, Homo sapiens; identical to SEQ ID NO: 567048
  misc_feature: HIJSMM301DZ1SE.5.86.H09.1.454.light.4.raw

SEQ ID NO: 597376 - DNA, 496 bp, Homo sapiens
  misc_feature: HIJSMM301EOB2R.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttctagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtggaaatcaaacgaactgtggctgcacc

SEQ ID NO: 597377 - DNA, 508 bp, Homo sapiens
  misc_feature: HIJSMM301EFD9J.9.12.B01.1.454.light.4.raw
  modified_base (430)..(430): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttcncgggcgttcggccaagggaccgaaggtaggaaatacaaacgaactgtggctgcaccatctgtcttcattccttccccg

SEQ ID NO: 597378 - DNA, 491 bp, Homo sapiens
  misc_feature: HIJSMM301DXQL7.11.81.H04.1.454.light.4.raw
cgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttttactgtcagcagtatagtaactggcctccgtacacttttggccaggggaccaagctagaaatcaaacgactgtggctgcaccatctgtcttc

SEQ ID NO: 597379 - DNA, 502 bp, Homo sapiens; identical to SEQ ID NO: 554531
  misc_feature: HIJSMM301EKA79.21.81.H04.1.454.light.4.raw

SEQ ID NO: 597380 - DNA, 505 bp, Homo sapiens; identical to SEQ ID NO: 542298
  misc_feature: HIJSMM301DBCB2.14.3.A03.1.454.light.4.raw

SEQ ID NO: 597381 - DNA, 493 bp, Homo sapiens; identical to SEQ ID NO: 535047
  misc_feature: HIJSMM301BLBE0.16.53.E09.1.454.light.4.raw

SEQ ID NO: 597382 - DNA, 501 bp, Homo sapiens
  misc_feature: HIJSMM301B1GVM.53.38.D05.1.454.light.4.raw
cgcgtatacacacgaccggtgctcgatttagtatctgatagttgggtttgggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaaacaatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactattactgtcaatctgcggacagcagtggttctcatgtggtattcggcggagggaccaagctgaccgtcctaggtcagcccaaggctgccccctggtcactcc

SEQ ID NO: 597383 - DNA, 505 bp, Homo sapiens; identical to SEQ ID NO: 571264
  misc_feature: HIJSMM301CEWP6.19.78.H01.1.454.light.4.raw

SEQ ID NO: 597384 - DNA, 476 bp, Homo sapiens; identical to SEQ ID NO: 541471
  misc_feature: HIJSMM301EBG1K.13.4.A04.1.454.light.4.raw

SEQ ID NO: 597385 - DNA, 477 bp, Homo sapiens; identical to SEQ ID NO: 537453
  misc_feature: HIJSMM301BQG7X.8.85.H08.1.454.light.4.raw

SEQ ID NO: 597386 - DNA, 494 bp, Homo sapiens; identical to SEQ ID NO: 558118
  misc_feature: HIJSMM301A0O5P.8.81.H04.1.454.light.4.raw

SEQ ID NO: 597387 - DNA, 498 bp, Homo sapiens; identical to SEQ ID NO: 549563
  misc_feature: HIJSMM301DHJWV.18.59.F04.1.454.light.4.raw

SEQ ID NO: 597388 - DNA, 511 bp, Homo sapiens
  misc_feature: HIJSMM301D65JL.22.36.D03.1.454.light.4.raw
acatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttcgactctgtctcctggtaccaacaacacccaggcaaaccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaattaggcgccactctcgtggttttcggcggaggcaccgaagtgaccgtcctcggtcagcccaaggctgccccctggtcact

SEQ ID NO: 597389 - DNA, 507 bp, Homo sapiens
  misc_feature: HIJSMM301BMXNP.43.38.D05.1.454.light.4.raw
tgtgagtagtcacgaccggtgctcgatttagtatctgatagttgggtttgggggagtcagacccagtcaggacacagcctggacatgagggtccccgctcagctcctggggctcctgctgctctggctcccaggtgccaaatgtgacatccagatgacccagtctccttccaccctgtctacatctgtaggagacagagtcaccatcacttgccgggccagtcagactattattacctggttggcctggtatcagcagaaaccagggaaagcccctaaactcctgatctttgaggcatctcgtttagaaagtggggtcccctcaaggttcagcggcagtgcatctgggacagatttcactctcaccatcagcagcctgcagcctgatgattttgcaacttattactgtcaacagtataatagttacccctggacgttcggtccaagggaccgacgggtggaaagtcaaacgaactagtggctgcaccatctgtcttcatcttcccgt

SEQ ID NO: 597390 - DNA, 505 bp, Homo sapiens; identical to SEQ ID NO: 555744
  misc_feature: HIJSMM301DQJ2B.7.71.G05.1.454.light.4.raw

SEQ ID NO: 597391 - DNA, 483 bp, Homo sapiens
  misc_feature: HIJSMM301EIXMW.43.24.C02.1.454.light.4.raw
tgtgagtagtcacgaccggtgctcgatttagtacagatcgttagggaaaggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatagaaacaactatttggattggtatctgcagaagccagggcagcctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccgctcactttcgcggagggaccaaggtggagatcaaacgaa

SEQ ID NO: 597392 - DNA, 500 bp, Homo sapiens
  misc_feature: HIJSMM301CCZMA.5.86.H09.1.454.light.4.raw
atcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgctctgggctccagactgaggatgaggctgactattactgcagctcatttgcaggcagccgtatactcttcggcggagggaccaagctgaccgtcctaggtcagcccaaggctgccccctc

SEQ ID NO: 597393 - DNA, 493 bp, Homo sapiens; identical to SEQ ID NO: 540693
  misc_feature: HIJSMM301BXNUW.22.65.F10.1.454.light.4.raw

SEQ ID NO: 597394 - DNA, 492 bp, Homo sapiens
  misc_feature: HIJSMM301EUXEZ.16.14.B03.1.454.light.4.raw
tgtactactccacgaccggtgctcgatttagtgtgagtagtttgggcttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaactgtggctgcaccat

SEQ ID NO: 597395 - DNA, 500 bp, Homo sapiens
  misc_feature: HIJSMM301C455U.41.45.E01.1.454.light.4.raw
tctatactatcacgaccggtgctcgatttagtgagtcagtaagggaaaggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaaggctgaccgtcctaggtcagccaaggctgcccctcggtcactc

SEQ ID NO: 597396 - DNA, 434 bp, Homo sapiens; identical to SEQ ID NO: 535153
  misc_feature: HIJSMM301D18ER.18.5.A05.1.454.light.4.raw

SEQ ID NO: 597397 - DNA, 494 bp, Homo sapiens; identical to SEQ ID NO: 577002
  misc_feature: HIJSMM301BMGD0.40.71.G05.1.454.light.4.raw

SEQ ID NO: 597398 - DNA, 509 bp, Homo sapiens
  misc_feature: HIJSMM301EHXU9.17.28.C06.1.454.light.4.raw
  modified_base (421)..(421): a, c, t, g, unknown or other
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattacngtgcaccgtgggatgacatcctgaatggtccggtgttcggcggagggaccaggctgaccgtcctaagtcagcccaaggctgccccctc

SEQ ID NO: 597399 - DNA, 483 bp, Homo sapiens
  misc_feature: HIJSMM301ADJ5P.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgagatgttggaagttattactgtcagacctatagtggtggcccgctcattttcggcggagggaccaaggtgcagatcaaacgaactgtggctgca

SEQ ID NO: 597400 - DNA, 496 bp, Homo sapiens
  misc_feature: HIJSMM301BKNYP.10.59.F04.1.454.light.4.raw
catagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgttggtggttatgactttgtctcctggtaccaacagcagccaggcgaagcccccaaattcatgatttatgatgtcagtgcgcggccctcgggggtccctgatcgcttctctggctccaagtctggcaacacggcctccctgaccatctctggcctccagcctgaggatgaggctgattattactgttgctcatatgcaggccggtaccgtcgttgggtgttcgggcggagggaccgaagctcgaccgtcctaggtcagaccccg

SEQ ID NO: 597401 - DNA, 457 bp, Homo sapiens; identical to SEQ ID NO: 539745
  misc_feature: HIJSMM301D5T2P.49.83.H06.1.454.light.4.raw

SEQ ID NO: 597402 - DNA, 481 bp, Homo sapiens
  misc_feature: HIJSMM301CTIBL.5.12.B01.1.454.light.4.raw
atcagacacgcacgaccggtgctcgatttagtagtgtagattccgcgggggcccactgttagggctcaggggctgtgtccaccatggcctggactcttctccttctcgtgctcctctctcactgcacaggttccctctcccagcctgtgctgactcagccatcttcccattctgcatcttctggagcatcagtcagactcacctgcatgctgagcagtggcttcagtgttggggacttctggataaggatatcagaggctgattgcagagtcaccttatagatcacttcatagacacagggaacagaagacacagacaactgaggaagcaaagtttaaattctactcacgtttgatttccaccttggtcccttggccgaacgtcctcgggtgttcggcggagggaccaagctgaccgtcctaggtcagcccaaggctcgccccctcggtcactctcgttcccgccctcctccgtgtctgat

SEQ ID NO: 597403 - DNA, 501 bp, Homo sapiens; identical to SEQ ID NO: 536142
  misc_feature: HIJSMM301DCQHG.15.1.A01.1.454.light.4.raw

SEQ ID NO: 597404 - DNA, 485 bp, Homo sapiens; identical to SEQ ID NO: 535501
  misc_feature: HIJSMM301ECAYV.3.10.A10.1.454.light.4.raw

SEQ ID NO: 597405 - DNA, 488 bp, Homo sapiens; identical to SEQ ID NO: 576475
  misc_feature: HIJSMM301C7J9F.3.55.E11.1.454.light.4.raw

SEQ ID NO: 597406 - DNA, 521 bp, Homo sapiens
  misc_feature: HIJSMM301BJY1Z.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctggacccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccaccct

SEQ ID NO: 597407 - DNA, 488 bp, Homo sapiens
  misc_feature: HIJSMM301CSR68.8.12.B01.1.454.light.4.raw
ctcgcgtgtccacgaccggtgctcgatttagtagtgtagattccgcggggctgggcctcaggaagcagcatcggaggtgcctcagccatggtatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggccctcagggatccctgagcgattctctggctccaactctgggaacacagccactctgaccatcagcgggacccaggctacggatgaggctgactattactgtcaggcgtgggacagcagcacctatgtggttttcggcggagggaccaagctgaccgtccttggtcagcccaaggctgccccctc

SEQ ID NO: 597408 - DNA, 508 bp, Homo sapiens; identical to SEQ ID NO: 541908
  misc_feature: HIJSMM301C94RX.47.85.H08.1.454.light.4.raw

SEQ ID NO: 597409 - DNA, 494 bp, Homo sapiens; identical to SEQ ID NO: 534992
  misc_feature: HIJSMM301BU3MB.9.1.A01.1.454.light.4.raw

SEQ ID NO: 597410 - DNA, 465 bp, Homo sapiens
  misc_feature: HIJSMM301C8NF7.48.22.B11.1.454.light.4.raw
agtatacatacacgaccggtgctcgatttagacgacagctcagggggcaggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggccagggaccaaagtggatgtcaaccgaa

SEQ ID NO: 597411 - DNA, 511 bp, Homo sapiens
  misc_feature: HIJSMM301B34DM.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcatcagcctggagcctgaagatgttgcagtttattactgtcaacatcgtaccgagtggcctccgggggccactttcggccctcgggaccaaggtggagatcaaacgaactgtggctgcaccatctgtcttcactcttcccg

SEQ ID NO: 597412 - DNA, 496 bp, Homo sapiens; identical to SEQ ID NO: 538149
  misc_feature: HIJSMM301AWYGP.13.67.G01.1.454.light.4.raw

SEQ ID NO: 597413 - DNA, 479 bp, Homo sapiens; identical to SEQ ID NO: 535586
  misc_feature: HIJSMM301BP799.13.34.D01.1.454.light.4.raw

SEQ ID NO: 597414 - DNA, 513 bp, Homo sapiens; identical to SEQ ID NO: 564131
  misc_feature: HIJSMM301AWOXY.14.78.H01.1.454.light.4.raw

SEQ ID NO: 597415 - DNA, 460 bp, Homo sapiens
  misc_feature: HIJSMM301EI39J.5.36.D03.1.454.light.4.raw
atcagacacgcacgaccggtgctcgatttagctgcgtcacgatctctcttgggcacgaccggtgctcgatttagctgcgtcacgatctctcttgggggagtcagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggcaacttattactgccaacagta

SEQ ID NO: 597416 - DNA, 523 bp, Homo sapiens
  misc_feature: HIJSMM301AOIMV.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccgaacggaccgaacggtaggaaggtacgaaacgaaactacgtggcgtgcgaccactctgtcttctatcttcccgtccctact

SEQ ID NO: 597417 - DNA, 516 bp, Homo sapiens; identical to SEQ ID NO: 567116
  misc_feature: HIJSMM301CKXNB.40.87.H10.1.454.light.4.raw

SEQ ID NO: 597418 - DNA, 506 bp, Homo sapiens
  misc_feature: HIJSMM301BYWQM.21.87.H10.1.454.light.4.raw
tcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaaactcttaatttctggcgtcaatcagcgaccctcacatgtttccagtcgattctctgcatccaagtctggcaacacggcctttctgacaatctctcaactccaggctgaagacgaggctatttattactgctcctcatacgcaggtggcacatttttcttggtttttggcggcgggacccagatgactgtcctcagtcagcccaaggctgccccctggt

SEQ ID NO: 597419 - DNA, 516 bp, Homo sapiens
  misc_feature: HIJSMM301CETYG.9.12.B01.1.454.light.4.raw
tgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcgaggctagaagatgtggctagtttattactgtacaacttagttttcgtcgggtcgttcggaccgaacggaaccgaaggtaggaatacaaacgtaacgtgtggcgtcgcaccta

SEQ ID NO: 597420 - DNA, 512 bp, Homo sapiens
  misc_feature: HIJSMM301EU7XM.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtaggaaagtacaaaacgaacctagtggcgtgtcaccatctgtcttctatctttccccg

SEQ ID NO: 597421 - DNA, 499 bp, Homo sapiens
  misc_feature: HIJSMM301A8RO5.52.86.H09.1.454.light.4.raw
cgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgacttattattgtcaatcaacagacaccattggtacttatgtcttcggaactgcgaccaaggtcaccgtctggtcaggcccaaggcccaaccccactcgtcactt

SEQ ID NO: 597422 - DNA, 499 bp, Homo sapiens
  misc_feature: HIJSMM301BC3E9.5.59.F04.1.454.light.4.raw
atcagacacgcacgaccggtgctcgatttagtacacacacttagggattgggggctctggagaagagctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgttcggccagggaccaaggtaggaaagtacaaacgaactagtggctgcaccatct

SEQ ID NO: 597423 - DNA, 473 bp, Homo sapiens
  misc_feature: HIJSMM301B1QYR.5.4.A04.1.454.light.4.raw
atcagacacgcacgaccggtgctcgatttagagtagtgatcagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggacaagtcagagcattagcaggtctttaaattggtatcagcacaaaccagggaaagcccctatgctcctgatctttgctgcatccagtttgcaaagtggggtcccatcaaggttcagtggcagtggatctgggacagatttcactctcaccatcagcagtctgcaagctgaagattttgcaacttattactgtcaacaaagttatagtaccccgacgttcggccaagggaccaaggtggagatcaaacgaactagtggctgcacc

SEQ ID NO: 597424 - DNA, 493 bp, Homo sapiens; identical to SEQ ID NO: 545970
  misc_feature: HIJSMM301B82I6.41.72.G06.1.454.light.4.raw

SEQ ID NO: 597425 - DNA, 477 bp, Homo sapiens; identical to SEQ ID NO: 552728
  misc_feature: HIJSMM301CEG6P.13.76.G10.1.454.light.4.raw

SEQ ID NO: 597426 - DNA, 484 bp, Homo sapiens; identical to SEQ ID NO: 535240
  misc_feature: HIJSMM301CF2ML.47.60.F05.1.454.light.4.raw

SEQ ID NO: 597427 - DNA, 488 bp, Homo sapiens
  misc_feature: HIJSMM301AZZTZ.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcggccagggaccgaaggtggaagtcaagcgaactgtgctgcaccatctgtt

SEQ ID NO: 597428 - DNA, 491 bp, Homo sapiens; identical to SEQ ID NO: 548736
  misc_feature: HIJSMM301DCFUM.40.81.H04.1.454.light.4.raw

SEQ ID NO: 597429 - DNA, 485 bp, Homo sapiens
  misc_feature: HIJSMM301A910A.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgactagtggctgcacat

SEQ ID NO: 597430 - DNA, 485 bp, Homo sapiens; identical to SEQ ID NO: 535985
  misc_feature: HIJSMM301CI8G0.15.1.A01.1.454.light.4.raw

SEQ ID NO: 597431 - DNA, 489 bp, Homo sapiens; identical to SEQ ID NO: 535091
  misc_feature: HIJSMM301EJX9A.47.36.D03.1.454.light.4.raw

SEQ ID NO: 597432 - DNA, 479 bp, Homo sapiens; identical to SEQ ID NO: 537163
  misc_feature: HIJSMM301AMOE1.13.73.G07.1.454.light.4.raw

SEQ ID NO: 597433 - DNA, 514 bp, Homo sapiens; identical to SEQ ID NO: 547648
  misc_feature: HIJSMM301C55LR.16.1.A01.1.454.light.4.raw

SEQ ID NO: 597434 - DNA, 484 bp, Homo sapiens; identical to SEQ ID NO: 535441
  misc_feature: HIJSMM301DC7HR.26.60.F05.1.454.light.4.raw

SEQ ID NO: 597435 - DNA, 486 bp, Homo sapiens
  misc_feature: HIJSMM301A1YRT.49.81.H04.1.454.light.4.raw
agtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccaactcactttcggcggagggaccacggtggagatcaaacgaactgtggctgcaccatctgtcttcta

SEQ ID NO: 597436 - DNA, 518 bp, Homo sapiens
  misc_feature: HIJSMM301BH5EV.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtggttcggcggagggaccaagctgaccgtcctaggtcagcccaaggctgccccctcggtcactctgttcccgccctccctcgctacgtagtac

SEQ ID NO: 597437 - DNA, 506 bp, Homo sapiens; identical to SEQ ID NO: 557726
  misc_feature: HIJSMM301E0LP5.47.83.H06.1.454.light.4.raw

SEQ ID NO: 597438 - DNA, 524 bp, Homo sapiens
  misc_feature: HIJSMM301B493T.53.77.G11.1.454.light.4.raw
cgcgtatacacacgaccggtgctcgatttagctagtcactcaagggaaaggggctgggcctaaggaagcagcactggtggtgcctcagccatggcctggaccgttctcctcctcggcctcctctctcactgcacaggctctgtgacctcctttgtgctgactcagtcaccctcggtgtcggtggccccaggacagacggccaggattacctgtgggggaaacaacattggaaggaaagtgtgcactggtaccagcagatgccaggccaggcccctgtgttggtcgtctatgatgatagcgaccggccctcaggggtccctgagcgattctctggctccaactctgggaacacggccaccctgaccataagcagggtcgaagccggggatgaggccgactattactgtcaggtgtgggatactagtagtgatcatccttgggtgttcggcggtgggaccaggctgaccgtcctaggtcagcccaaggctgccccctcggtcactctgttcccaccctcctctccg

SEQ ID NO: 597439 - DNA, 506 bp, Homo sapiens
  misc_feature: HIJSMM301ADUCP.13.25.C03.1.454.light.4.raw
tcacgtactacacgaccggtgctcgatttagtagtgtagatttgggtttggggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatcttgggacttatagacttgtctcctggtaccaacaccacccaggcaaggcccccagagtcatcatttatgggggcaataggcggccgtcagggatttccactcgcttctctggctccaagtctggcaacacggcctccctgacaatctctggtctccaggctgaggacgaggctgcctattactgctgctcatatgcaggttcttctgtggtcttcggcggagggtccaaagtgaccgtcctaggtcagcccaaggctgccccctcggtcact

SEQ ID NO: 597440 - DNA, 486 bp, Homo sapiens; identical to SEQ ID NO: 535385
  misc_feature: HIJSMM301BPPB3.19.71.G05.1.454.light.4.raw

SEQ ID NO: 597441 - DNA, 491 bp, Homo sapiens
  misc_feature: HIJSMM301EIKGD.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactaactgtcaacagacttacagtgccccccgatcaccttcggccaagggacacgactggagattaaacgaactgtggctgcaccatctgtcttcatt

SEQ ID NO: 597442 - DNA, 504 bp, Homo sapiens
  misc_feature: HIJSMM301BONP7.19.10.A10.1.454.light.4.raw
tactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccgataagagtgttgacagcaccttctttgcctggtaccagcagagacctggccaggctcccaggctcctcgtttatggtgcgtccaccagggccactggcatcccccgacaggttcagtggcagtgtgtctgggacagacttcactctcaccatcagcagactggagcctgaagattttgcagtgtattactgtcaacgatatgatgagtcacctccgtggtggacatttggccaggggaccaaggttgaagtcaaacgaactgtggctgcaccatctgtcttcatcttccccg

SEQ ID NO: 597443 - DNA, 487 bp, Homo sapiens
  misc_feature: HIJSMM301D254J.51.6.A06.1.454.light.4.raw
cgatcgtatacacgaccggtgctcgatttagatctactgacaggggcctggggagcctagctgtgctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtggtacttatgtcttcggaactgggaccaaggtcaccgtcctaggtcacg

SEQ ID NO: 597444 - DNA, 499 bp, Homo sapiens
  misc_feature: HIJSMM301A55G0.21.38.D05.1.454.light.4.raw
tcgtcgctcgcacgaccggtgctcgatttagtatctgatagttgggtttggggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaagagttactctctcctgcaaggccagtcagagtgttggcatcgacgttgcctggtaccaacaaaaacctggccaggctcccagtctcctcatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtggctgcaccatctgtcttcat

SEQ ID NO: 597445 - DNA, 460 bp, Homo sapiens; identical to SEQ ID NO: 536053
  misc_feature: HIJSMM301EWOFS.22.28.C06.1.454.light.4.raw

SEQ ID NO: 597446 - DNA, 494 bp, Homo sapiens; identical to SEQ ID NO: 535478
  misc_feature: HIJSMM301BKF6F.10.79.H02.1.454.light.4.raw

SEQ ID NO: 597447 - DNA, 490 bp, Homo sapiens
  misc_feature: HIJSMM301APQPM.10.59.F04.1.454.light.4.raw
catagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgttggtggttatgactttgtctcctggtaccaacagcagccaggcgaagcccccaaattcatgatttatgatgtcagtgcgcggccctcgggggtccctgatcgcttctctggctccaagtctggcacacggcctccctgaccatctctggccttccagcctgaggatgaggctgattattactgttgctcatatgcaggcggtaccgcttgggtgttcggcggagggaccaagctgaccgtcctaggtcagaccccg

SEQ ID NO: 597448 - DNA, 490 bp, Homo sapiens
  misc_feature: HIJSMM301C7T09.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgctaacttactactgtcaacagagttacacgtacccccctcactttcggcggaggaccaaggcggagatcagacgaactgtggctgcaccatctgtcttcta

SEQ ID NO: 597449 - DNA, 485 bp, Homo sapiens; identical to SEQ ID NO: 543370
  misc_feature: HIJSMM301D3L1F.3.10.A10.1.454.light.4.raw

SEQ ID NO: 597450 - DNA, 501 bp, Homo sapiens
  misc_feature: HIJSMM301CFD3V.5.86.H09.1.454.light.4.raw
atcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaaggctgaccgtcctaggtcagccaaggctgccccctc

SEQ ID NO: 597451 - DNA, 519 bp, Homo sapiens
  misc_feature: HIJSMM301DOMR2.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcgggacccagaccctggagcctcagttggaagcagccgatccagcctgcggagcctgtggggcaggtcagcccaaggcctaccgccctcggtcactctgttcccgccctcctccacg

SEQ ID NO: 597452 - DNA, 480 bp, Homo sapiens
  misc_feature: HIJSMM301ESMK0.11.17.B06.1.454.light.4.raw
cgagagataccacgaccggtgctcgatttagtcgatagtgaagggggcaggagtcagtctcagtcaggacacagcatggacatgagggtccccgctcagctcccggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagatttgcaacttactactgtcaacagagttacagtaccccgtggacgttcggccaagggaccaaggtggaaatacaaacgaactagtggctgcacc

SEQ ID NO: 597453 - DNA, 496 bp, Homo sapiens; identical to SEQ ID NO: 535109
  misc_feature: HIJSMM301EZD5A.16.78.H01.1.454.light.4.raw

SEQ ID NO: 597454 - DNA, 502 bp, Homo sapiens
  misc_feature: HIJSMM301DVNRP.15.37.D04.1.454.light.4.raw
tctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttgccgggccagtcaaaatattactaggtggttggcctggtatcagcagaaaccagggaaggcccctaagtccctcatcaagaaggcgtctactttagaagctggggtcccgtcaagattcagcgccggtggatctgggacagaattcactctcaccatcaacagcctggaacctgatgattttgcaacttattactgccaacactatgatactcacccgtacacttttggccaggggaccaagctggagatcaaaggaactgtggctgcaccatctgtcttcatcttcccgt

SEQ ID NO: 597455 - DNA, 507 bp, Homo sapiens; identical to SEQ ID NO: 563344
  misc_feature: HIJSMM301DNY4E.3.79.H02.1.454.light.4.raw

SEQ ID NO: 597456 - DNA, 497 bp, Homo sapiens; identical to SEQ ID NO: 536807
  misc_feature: HIJSMM301A9YGH.10.37.D04.1.454.light.4.raw

SEQ ID NO: 597457 - DNA, 506 bp, Homo sapiens; identical to SEQ ID NO: 543046
  misc_feature: HIJSMM301B2DDA.53.71.G05.1.454.light.4.raw

SEQ ID NO: 597458 - DNA, 519 bp, Homo sapiens; identical to SEQ ID NO: 556598
  misc_feature: HIJSMM301DIQUP.12.71.G05.1.454.light.4.raw

SEQ ID NO: 597459 - DNA, 505 bp, Homo sapiens; identical to SEQ ID NO: 538496
  misc_feature: HIJSMM301BYIAF.48.71.G05.1.454.light.4.raw

SEQ ID NO: 597460 - DNA, 484 bp, Homo sapiens; identical to SEQ ID NO: 553263
  misc_feature: HIJSMM301E10JG.46.26.C04.1.454.light.4.raw
  modified_base (445)..(445): a, c, t, g, unknown or other

SEQ ID NO: 597461 - DNA, 491 bp, Homo sapiens
  misc_feature: HIJSMM301D6WPE.52.52.E08.1.454.light.4.raw
cgcagtacgacacgaccggtgctcgatttagtcgagctctcagagagaaaggggtgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgcacacagtgatggaaacacctacttgaattggtttcagcagaggccaggccaatctccaaggcgcctaatttataaggtttctcaccgggactctggggtcccagacagattcagcggcagtgggtcaggcactgatttcacgctgaaaatcagcaggtggaggctgaagatgttggggtttattactgcatgcaaggcacacactggcctgcgtacacttttggccaggggaccaagctggagaggaaacgaactgt

SEQ ID NO: 597462 - DNA, 475 bp, Homo sapiens
  misc_feature: HIJSMM301CAUF1.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcggacccaggctatggatgaggctgactattactgtcaggcgtgggacagcagcactgcccgctatgtcttcggaactgggaccaaggtcaccgtcctaagtcagaccccg

SEQ ID NO: 597463 - DNA, 488 bp, Homo sapiens; identical to SEQ ID NO: 542699
  misc_feature: HIJSMM301DAK7J.12.51.E07.1.454.light.4.raw

SEQ ID NO: 597464 - DNA, 488 bp, Homo sapiens
  misc_feature: HIJSMM301DT0QG.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccgaaggtggagatcaaacgaact

SEQ ID NO: 597465 - DNA, 493 bp, Homo sapiens; identical to SEQ ID NO: 535047
  misc_feature: HIJSMM301EAJPU.16.53.E09.1.454.light.4.raw

SEQ ID NO: 597466 - DNA, 491 bp, Homo sapiens; identical to SEQ ID NO: 548736
  misc_feature: HIJSMM301AP50F.40.81.H04.1.454.light.4.raw

SEQ ID NO: 597467 - DNA, 480 bp, Homo sapiens; identical to SEQ ID NO: 588469
  misc_feature: HIJSMM301D5DKV.5.70.G04.1.454.light.4.raw

SEQ ID NO: 597468 - DNA, 502 bp, Homo sapiens; identical to SEQ ID NO: 541971
  misc_feature: HIJSMM301A8437.4.39.D06.1.454.light.4.raw

SEQ ID NO: 597469 - DNA, 484 bp, Homo sapiens; identical to SEQ ID NO: 555091
  misc_feature: HIJSMM301D8JO6.3.55.E11.1.454.light.4.raw

SEQ ID NO: 597470 - DNA, 507 bp, Homo sapiens; identical to SEQ ID NO: 549050
  misc_feature: HIJSMM301C7SF8.18.37.D04.1.454.light.4.raw

SEQ ID NO: 597471 - DNA, 515 bp, Homo sapiens
  misc_feature: HIJSMM301B83FH.52.57.F02.1.454.light.4.raw
cgcagtacgacacgaccggtgctcgatttagctcgatatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttatgactttgtctcctggtaccaacaccaccctggcaaagcccccaaactcatcatttttgaggtcactaagcggccctcaggggtccctgatcgcttctctggctcgaagtctggcaacacggcctccctgaccgtctctgggctccaggctgaggatgaggctgattactactgcacctcatatgcaggcgacaacaatttggggttttcggcggagggaccaaggtgaccgtcctacgtcagcccaaggctgccccctcggtcactctgtt

SEQ ID NO: 597472 - DNA, 488 bp, Homo sapiens; identical to SEQ ID NO: 536554
  misc_feature: HIJSMM301DV2BY.26.37.D04.1.454.light.4.raw

SEQ ID NO: 597473 - DNA, 498 bp, Homo sapiens
  misc_feature: HIJSMM301BM98X.51.87.H10.1.454.light.4.raw
cgatcgtatacacgaccggtgctcgatttagcagtactgcgttgggtttgggggggagcctagctgtgctgtgggtccaggaggcagaactctgggtgtctcaccatggcctggatccctctacttctccccctcctcactctctgcacaggctctgaggcctcctatgagctgacacagccagcctcggtgtcagtgtccccaggacagacggccaagatcccctgctctggagatgcattgccaaaacgatttgctttttggtaccaacagaagccaggccaggcccctataataattatatataaagacagtgagaggccctcagggatccctgagcgattctctggctccagctcagggacaacagccacgttgacgattagtggagtccaggcagaagacgaggctgactattactgtcaatcagcagacgacagtggtacttatggagtattcggcggagggaccaaggtgaccgtctaggtcagcccaagg

SEQ ID NO: 597474 - DNA, 496 bp, Homo sapiens
  misc_feature: HIJSMM301DJQLJ.3.33.C11.1.454.light.4.raw
agacgcactccacgaccggtgctcgatttagagtgagctcgttgggtttgggggctttgcctgggctctgctcctcctcaccctcctcactcagggcacagggtcctggacccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgtttccaccctcctcgagtgcgtct

SEQ ID NO: 597475 - DNA, 505 bp, Homo sapiens
  misc_feature: HIJSMM301EDFKM.48.36.D03.1.454.light.4.raw
agtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttcaagtttcctttttgttcttcggaactgggaccgaggtcaccgtcctaggtcagcccaaggccaacccactgtcta

SEQ ID NO: 597476 - DNA, 485 bp, Homo sapiens; identical to SEQ ID NO: 536210
  misc_feature: HIJSMM301CO0RO.43.54.E10.1.454.light.4.raw

SEQ ID NO: 597477 - DNA, 488 bp, Homo sapiens
  misc_feature: HIJSMM301AQMI9.22.73.G07.1.454.light.4.raw
acatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtatccccgccaggttcagtgccagtgggtctgggacagagttcactctcaccatcagcagcctgcagtctgaagattttgcacttttattactgtcagcaatataatgactggttctcgatcaccttcggccaagggacacgactggagattaaacgaactgtggctgcaccatctgtt

SEQ ID NO: 597478 - DNA, 470 bp, Homo sapiens
  misc_feature: HIJSMM301CCNJH.13.48.E04.1.454.light.4.raw
tcacgtactacacgaccggtgctcgatttagagagcgtcacagagagaaggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaagtggggtcccatcaaggttcagcggcagtggatctggcacagacttcattctcaccatcagcagcctgcagcctgaagattttgcaacttattactgtctacaagatcacaattatcctgggacgttcggccaaggaccaaggtggaaatcaaacgaa

SEQ ID NO: 597479 - DNA, 487 bp, Homo sapiens
  misc_feature: HIJSMM301CLHTC.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcagtgggtcaggcgctgatttcacactgagaatcagcagggtggaggctgaagatgtcggggtttattactgcatgcagggtacagtgtggccttcgctcgcattcggcgagggaccaaggtggagatcaaacgaa

SEQ ID NO: 597480 - DNA, 447 bp, Homo sapiens; identical to SEQ ID NO: 535201
  misc_feature: HIJSMM301BBJ8K.18.9.A09.1.454.light.4.raw

SEQ ID NO: 597481 - DNA, 503 bp, Homo sapiens; identical to SEQ ID NO: 542390
  misc_feature: HIJSMM301D60P7.15.25.C03.1.454.light.4.raw

SEQ ID NO: 597482 - DNA, 515 bp, Homo sapiens
  misc_feature: HIJSMM301D5D4J.13.38.D05.1.454.light.4.raw
  modified_base (499)..(499): a, c, t, g, unknown or other
tcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttacccctcaccatcaggggtctacagcctgaagattttgcgacttactattgtcaacagagttaccttctcccccggacgttcgtccgaacggaccgaaggtaggaagtacaagacgaacgtagtggcgtgcgaccaactctntcttctatcttcccgt

SEQ ID NO: 597483 - DNA, 518 bp, Homo sapiens
  misc_feature: HIJSMM301CESYX.51.43.D10.1.454.light.4.raw
  modified_base (507)..(507): a, c, t, g, unknown or other
cgatcgtatacacgaccggtgctcgatttagactagcagtaaggggagtctgggcctaaggaagcagcactggtggtgcctcagccatggcctggaccgttctcctcctcggcctcctctctcactgcacagtctctgtgacatcctatgtgctgactcagccaccctcggtgtcagtggccccaggacagacggccaggatttcctgtgggggagacaacattggaagtaaaagtgtacactggtaccagcagaggccaggccaggcccctgtgttggtcgtctatgattataacgaccggccctcagggatccctgaccgattctctggctccatctctgggaacacggccactctgaccatcagcagggtcgaagccggggatgaggccgactattactgtcaggtgtgggaaagtagtagtgatcattatgtcttcggaagtgggaccaaggtcaccgtcctaggtcagcccaaggccaaccccactgtcactctcgttcccnccctcctctcg

SEQ ID NO: 597484 - DNA, 504 bp, Homo sapiens
  misc_feature: HIJSMM301B4R8M.51.2.A02.1.454.light.4.raw
cgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattacctgtgggggaaacaacattggaagtaaaactgtgcactggtaccagcagaagccaggtcaggcccctgtgctggtcgtctatgatgatgccgaccggccctcagggatccctgaacgattctctggctccagctctgagaacacggccaccctgagcatcagcagggtcgaagccggggatgaggccgactattactgtcaggtgtgggatactagtagtgatcatgtcttcggacctgggaccaaggtcaccgtcctaggtcagcccaaggccaaccccactgtcactctgttcccaccct

SEQ ID NO: 597485 - DNA, 500 bp, Homo sapiens
  misc_feature: HIJSMM301BJ44C.48.30.C08.1.454.light.4.raw
agtatacatacacgaccggtgctcgatttagtctgacgtcaaagggaaagggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaagggacacgactggagattaaacgaactgtggctgcaccatctgtcttcatcttcccg

SEQ ID NO: 597486 - DNA, 499 bp, Homo sapiens; identical to SEQ ID NO: 539172
  misc_feature: HIJSMM301D4KEO.48.36.D03.1.454.light.4.raw

SEQ ID NO: 597487 - DNA, 516 bp, Homo sapiens
  misc_feature: HIJSMM301BJP7G.10.26.C04.1.454.light.4.raw
catagtagtgcacgaccggtgctcgattagtctagcgactttgggtttgggggctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagccctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttcatcttcccgcc

SEQ ID NO: 597488 - DNA, 505 bp, Homo sapiens; identical to SEQ ID NO: 535503
  misc_feature: HIJSMM301AN7A1.8.28.C06.1.454.light.4.raw

SEQ ID NO: 597489 - DNA, 506 bp, Homo sapiens
  misc_feature: HIJSMM301EDP4G.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccggacgtcgtccaggaccgaacggtaggaagtacaacgaaacgtgtggctgcaccatctgtcttcatcttccgcccact

SEQ ID NO: 597490 - DNA, 497 bp, Homo sapiens; identical to SEQ ID NO: 536376
  misc_feature: HIJSMM301CR3EI.22.9.A09.1.454.light.4.raw

SEQ ID NO: 597491 - DNA, 492 bp, Homo sapiens
  misc_feature: HIJSMM301A5AH4.19.71.G05.1.454.light.4.raw
tactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaaggaccaaggtaggagtatcagacgaactgtg

SEQ ID NO: 597492 - DNA, 512 bp, Homo sapiens; identical to SEQ ID NO: 536795
  misc_feature: HIJSMM301AV8VC.15.76.G10.1.454.light.4.raw

SEQ ID NO: 597493 - DNA, 495 bp, Homo sapiens
  misc_feature: HIJSMM301BBAIN.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggactttcggccctgggaccaaacgtggagatcaaacgaactgtggctgcaccatctgtctt

SEQ ID NO: 597494 - DNA, 492 bp, Homo sapiens; identical to SEQ ID NO: 535126
  misc_feature: HIJSMM301EMEPQ.18.11.A11.1.454.light.4.raw

SEQ ID NO: 597495 - DNA, 483 bp, Homo sapiens
  misc_feature: HIJSMM301DOYMT.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggcggagggaccaaggtgcagatcaaacgactgtggctgca

SEQ ID NO: 597496 - DNA, 488 bp, Homo sapiens; identical to SEQ ID NO: 579007
  misc_feature: HIJSMM301BMX49.26.23.C01.1.454.light.4.raw

SEQ ID NO: 597497 - DNA, 496 bp, Homo sapiens
  misc_feature: HIJSMM301AKFCY.26.80.H03.1.454.light.4.raw
  modified_base (447)..(447): a, c, t, g, unknown or other
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagtttttaccctcacaactcatatcacagaatctgaggatgctgcattttacttcggtctacaacatgataatttccctcgtggacgttcggccaagggaccaaggancaaatcaaacgaactgtggctgcaccatctgtcttcatcttcccgccat

SEQ ID NO: 597498 - DNA, 509 bp, Homo sapiens; identical to SEQ ID NO: 536339
  misc_feature: HIJSMM301EMCOM.17.33.C11.1.454.light.4.raw

SEQ ID NO: 597499 - DNA, 505 bp, Homo sapiens; identical to SEQ ID NO: 545042
  misc_feature: HIJSMM301BVOK1.19.78.H01.1.454.light.4.raw

SEQ ID NO: 597500 - DNA, 502 bp, Homo sapiens; identical to SEQ ID NO: 541971
  misc_feature: HIJSMM301BJP1V.4.39.D06.1.454.light.4.raw

SEQ ID NO: 597501 - DNA, 498 bp, Homo sapiens
  misc_feature: HIJSMM301DXM0A.40.38.D05.1.454.light.4.raw
tctagcgactcacgaccggtgctcgatttagtatctgatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgctgctcttatgcaggcagtttcgctctcgaagtgttcggcggagggaccgagctgaccgtcctacgtcagcccaaggctccg

SEQ ID NO: 597502 - DNA, 499 bp, Homo sapiens; identical to SEQ ID NO: 560695
  misc_feature: HIJSMM301CZYT5.2.34.D01.1.454.light.4.raw

SEQ ID NO: 597503 - DNA, 486 bp, Homo sapiens; identical to SEQ ID NO: 557420
  misc_feature: HIJSMM301ETIBP.19.71.G05.1.454.light.4.raw

SEQ ID NO: 597504 - DNA, 495 bp, Homo sapiens; identical to SEQ ID NO: 538673
  misc_feature: HIJSMM301CV9EF.51.35.D02.1.454.light.4.raw

SEQ ID NO: 597505 - DNA, 498 bp, Homo sapiens
  misc_feature: HIJSMM301CLMUO.40.4.A04.1.454.light.4.raw
tctagcgactcacgaccggtgctcgatttagagtagtgatcagggggctacaacaggcaggcaggggcagcaagatggtgttgcagacccaggtcttcatttctctgttcctctggatctctggtgccttcggggacatcgtgatgacccagtctccagactccctggctctgtctctgggcgagagggccaccatcaactgcaagtccagccagagcgttttatccacttcctacaatcagaattacttagcttggtatcagcataaaccagggcagcctccgaggctgctcatttactggacatctatccgggaatccggggtccctgaccgattccgtggcagtgggtctgggacagattttactctcaccatcaccagccttcaggctgaagatgtggcagtttatactgtcaccaatatttagacattcctccgacgttcggccaagggaccaaggtggagatcaaacgaactgtggctgcaccatctgtctt

SEQ ID NO: 597506 - DNA, 486 bp, Homo sapiens
  misc_feature: HIJSMM301BJXW3.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtgacagtgggtctgggacagacttcactctcaccatcagcagactggagcctgaagattttgcagtctattactgtcagcagtatggtcacgtcccaagaacttttggccaggggaccaagctggagatcaaacgaactgtggctgcaccat

SEQ ID NO: 597507 - DNA, 492 bp, Homo sapiens
  misc_feature: HIJSMM301BY8BL.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagatacctctggagaaacagtgatgacgcagtctccagccaccctctctgtgtctccaggggaaagagtcaccctctcctgcagggccagtcagagtgttagcagcaacttagcctggtatcagcagaaacctggccaggctcccaggctcctcatctatgatgcatccaccagggccactggtatcccagccaggttcagtggcagtgggtttgggacagagttcactctcaccatcagcagcctgcagtctgaagattttgcagtttattactgtcagcagtataataactggcctccggtcactttcggcggaggaccaaggtggagatcaaacgaactgtggctgcaccatctgt

SEQ ID NO: 597508 - DNA, 511 bp, Homo sapiens; identical to SEQ ID NO: 549024
  misc_feature: HIJSMM301AWTIB.14.7.A07.1.454.light.4.raw

SEQ ID NO: 597509 - DNA, 510 bp, Homo sapiens
  misc_feature: HIJSMM301B1YER.7.34.D01.1.454.light.4.raw
cgtgtctctacacgaccggtgctcgatttagatcgtctgtgttggggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggctccctgaccatctctggactccagactgaggacgaggctgattattactgctgctcatatacaggggacagcattatttgggtgttcggcggagggaccaagctgaccgtcctgcgtcagcccaaggctgcccctcggtcact

SEQ ID NO: 597510 - DNA, 498 bp, Homo sapiens
  misc_feature: HIJSMM301EP85M.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttggtggttatacatatgtctcctggtaccaacagcacccaggcaaagcccccaaactcatgatttatgaggtcaataagcggccgtcaggggtccctgatcgcttctctggctccaagtctggcaacacggccaccctgaccgtctctgggctccaggctgaggatgaggctcattattactgcagctcatatacaggcaaacaagaatttggtgttcggcggagggaccgagctgaccgtcctaggtccagcccaaggctccg

SEQ ID NO: 597511 - DNA, 495 bp, Homo sapiens
  misc_feature: HIJSMM301EQL3E.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctcgcaccatctgtctt

SEQ ID NO: 597512 - DNA, 486 bp, Homo sapiens; identical to SEQ ID NO: 535043
  misc_feature: HIJSMM301ARCEG.46.35.D02.1.454.light.4.raw

SEQ ID NO: 597513 - DNA, 506 bp, Homo sapiens
  misc_feature: HIJSMM301DD0YD.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccggggccactttcggccctggaccaaggtggagatcaaacgaactgtggctgcaccatctgtcttcta

SEQ ID NO: 597514 - DNA, 497 bp, Homo sapiens; identical to SEQ ID NO: 548712
  misc_feature: HIJSMM301AVAWN.13.10.A10.1.454.light.4.raw

SEQ ID NO: 597515 - DNA, 486 bp, Homo sapiens; identical to SEQ ID NO: 538219
  misc_feature: HIJSMM301D5L5Z.47.70.G04.1.454.light.4.raw

SEQ ID NO: 597516 - DNA, 489 bp, Homo sapiens
  misc_feature: HIJSMM301BGC16.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaactgtgctgcaccatctgtcttcat

SEQ ID NO: 597517 - DNA, 487 bp, Homo sapiens; identical to SEQ ID NO: 536206
  misc_feature: HIJSMM301CN8PP.47.38.D05.1.454.light.4.raw

SEQ ID NO: 597518 - DNA, 486 bp, Homo sapiens; identical to SEQ ID NO: 535043
  misc_feature: HIJSMM301CXWZO.46.35.D02.1.454.light.4.raw

SEQ ID NO: 597519 - DNA, 506 bp, Homo sapiens; identical to SEQ ID NO: 563474
  misc_feature: HIJSMM301EQBCH.10.27.C05.1.454.light.4.raw

SEQ ID NO: 597520 - DNA, 510 bp, Homo sapiens
  misc_feature: HIJSMM301AMN21.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccggggccactttcggccctcgggaccaaaggtggagatcaaacgaactagtggctgcaccatctgtcttcta

SEQ ID NO: 597521 - DNA, 519 bp, Homo sapiens
  misc_feature: HIJSMM301EDLBP.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcagggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaaccccactgtcactctgttcccgccctcct

SEQ ID NO: 597522 - DNA, 511 bp, Homo sapiens; identical to SEQ ID NO: 545382
  misc_feature: HIJSMM301E1ZBZ.15.34.D01.1.454.light.4.raw

SEQ ID NO: 597523 - DNA, 498 bp, Homo sapiens
  misc_feature: HIJSMM301CXTUB.41.82.H05.1.454.light.4.raw
tctatactatcacgaccggtgctcgatttagtcgagctctctcgcgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgccgggccagtcagagtattagtacctggttggcctggtatcagcagaaaccagggaaagcccctaagttcctgatatataaggcgtctagtttagaaagtgggtcccatcaaggatcagcggcagtggatctgggacagaattcactctcaccattagtagcctgcagcctgatgattttgcaacttattactgccaacaatataatgattttccgtggacgttcggccaagggaccaaggtagaaatacaaacgaactgtggctgcaccatctgtcttcatcttccccg

SEQ ID NO: 597524 - DNA, 508 bp, Homo sapiens
  misc_feature: HIJSMM301B9C70.8.1.A01.1.454.light.4.raw
  modified_base (501)..(501): a, c, t, g, unknown or other
ctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgccaaagaaatatgcttattggtaccagcagaagtcaggccaggcccctgtcctggtcatttatgaggacaagaaacgaccctccgggatccctgacagactctctggctccagctcagggacagtggccaccttgactatcactggggcccaggtggaggatgaaggagactactattgttactctccagagaaggatggtcatcattgggtgttcggcggagggaccaagctgaccgtcctaagtcagcccaaggctgccccctcggtcactctgttcccnccctccc

SEQ ID NO: 597525 - DNA, 483 bp, Homo sapiens
  misc_feature: HIJSMM301DMPXK.49.28.C06.1.454.light.4.raw
agtcgagagacacgaccggtgctcgatttagagctcacgtattgggtttggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataattactggctcgtttttggccaggggaccaagctggagatcaaagcgaaactgtggctgcacat

SEQ ID NO: 597526 - DNA, 489 bp, Homo sapiens
  misc_feature: HIJSMM301DEJWG.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatccacttttggccaagggaccaagactggagatcaaacgaactgtgctgcacca

SEQ ID NO: 597527 - DNA, 503 bp, Homo sapiens
  misc_feature: HIJSMM301BXWMP.41.19.B08.1.454.light.4.raw
tctatactatcacgaccggtgctcgatttagtgagtcagtaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatttacaaccagccacaccttgctcttcggaactgggaccacggtcatcgtcctaggtcagcccaaggccaacccactgtcact

SEQ ID NO: 597528 - DNA, 454 bp, Homo sapiens; identical to SEQ ID NO: 534964
  misc_feature: HIJSMM301AEHIH.19.86.H09.1.454.light.4.raw

SEQ ID NO: 597529 - DNA, 480 bp, Homo sapiens; identical to SEQ ID NO: 535630
  misc_feature: HIJSMM301DLICG.40.59.F04.1.454.light.4.raw

SEQ ID NO: 597530 - DNA, 520 bp, Homo sapiens
  misc_feature: HIJSMM301DT1MT.12.71.G05.1.454.light.4.raw
atacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagcccaaggctgcccctcggtcactctgttcccaccct

SEQ ID NO: 597531 - DNA, 509 bp, Homo sapiens
  misc_feature: HIJSMM301A4TFH.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtacacttttggccaggggacccaggtggagatcagactgatattaacagcgaaagagattttgttaagggaaagtaatgaagttaa

SEQ ID NO: 597532 - DNA, 485 bp, Homo sapiens; identical to SEQ ID NO: 536576
  misc_feature: HIJSMM301AHVKH.46.35.D02.1.454.light.4.raw

SEQ ID NO: 597533 - DNA, 509 bp, Homo sapiens
  misc_feature: HIJSMM301AGFAY.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttaacctggtatcagcagaggcctggccaggctcccagactcctcatctttggcgcctttaacagggccagtggaatcccagccaggttcagcagcagtgggtctgggacttcgttcactctcaccatcaataacctgcaatctgacgactttgcagtttatttctgtcagcagtctgaagactggccgttctactttcggcggagggaccgaaggtggaccgtacaaacgaactgtggctgcaccatctgtcttcatcttcccgcc

SEQ ID NO: 597534 - DNA, 494 bp, Homo sapiens; identical to SEQ ID NO: 535629
  misc_feature: HIJSMM301C2RA5.4.27.C05.1.454.light.4.raw

SEQ ID NO: 597535 - DNA, 504 bp, Homo sapiens
  misc_feature: HIJSMM301DSA9I.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaagtggatatcaaacgaactagtggctgcaccatctgtt

SEQ ID NO: 597536 - DNA, 486 bp, Homo sapiens
  misc_feature: HIJSMM301B1QP0.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaaggaccaaggtggatatcagacgaaa

SEQ ID NO: 597537 - DNA, 497 bp, Homo sapiens; identical to SEQ ID NO: 568187
  misc_feature: HIJSMM301EOEC6.48.31.C09.1.454.light.4.raw

SEQ ID NO: 597538 - DNA, 486 bp, Homo sapiens; identical to SEQ ID NO: 535458
  misc_feature: HIJSMM301C55CK.7.75.G09.1.454.light.4.raw

SEQ ID NO: 597539 - DNA, 479 bp, Homo sapiens; identical to SEQ ID NO: 537163
  misc_feature: HIJSMM301AYJZ7.13.73.G07.1.454.light.4.raw

SEQ ID NO: 597540 - DNA, 505 bp, Homo sapiens
  misc_feature: HIJSMM301CL4AN.12.86.H09.1.454.light.4.raw
atacgacgtacacgaccggtgctcgatttagtgctatagacttgggtttgggggagggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatcctatgatgcatccaaaagggccactggcatcccagccaggttcagtggcagtgggtctggggcagacttcactctcaccatcagcagcctagagcctgaagattttgcagtttattactgtcagcagcgtagcaactggcctcggttcactttttggcctaggggaccaaggctggagatcaaacgaactgtggctgcaccatctgtcttcatt

SEQ ID NO: 597541 - DNA, 447 bp, Homo sapiens; identical to SEQ ID NO: 535020
  misc_feature: HIJSMM301BEA20.18.9.A09.1.454.light.4.raw

SEQ ID NO: 597542 - DNA, 491 bp, Homo sapiens
  misc_feature: HIJSMM301CY1FO.18.22.B11.1.454.light.4.raw
tacgagtatgcacgaccggtgctcgatttagacgacagctcaggggcagcaagatggtgttgcagacccaggtcttcatttctctgttgctctggatctctggtacctacggggacttcgtgatgacccagtctccagactccctggctgtgtctctgggcgagagggccaccatcaactgcaagtccagccagagtattttaaagaactccaacaatcagaattacttaacttggtatcagcagaaagcaggccagcctcccaagttgctcatttactgggcatcaacccgggaatccggggtccctgaccgattcagtggcagcgggtctgggacagacttcactctcaccatcagcagcctgcaggctgaagatgtggcagtttattactgtcagcagtattatagtactcctccgacgttcggccaagggaccaaggtggagattaaacgaactgtggctgcaccatctgtctcatcttcccgccat

SEQ ID NO: 597543 - DNA, 510 bp, Homo sapiens
  misc_feature: HIJSMM301AJTDP.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggtccacggggaccgaccggtacgggtagtagtctaacgacgaacgtacgtggtcgtggtcgaccaactcttcg

SEQ ID NO: 597544 - DNA, 499 bp, Homo sapiens
  misc_feature: HIJSMM301CS1ND.43.14.B03.1.454.light.4.raw
tgtgagtagtcacgaccggtgctcgatttagtgtgagtagttccgcggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcacttatgtcttcggaactgggaccaaggtcaccgacctaggtcagcccaaggccaacccca

SEQ ID NO: 597545 - DNA, 503 bp, Homo sapiens
  misc_feature: HIJSMM301ERC2F.43.12.B01.1.454.light.4.raw
tgtgagtagtcacgaccggtgctcgatttagtagtgtagatttcgggtttcgggtgatcaaggactcctcagttcaccttcgtcacgaataggaggctccctgctcagctcctggggctgctaatgctctgggtcccaggatccagtggggatgttgtgatgactcagtctccactctccctgcccgtcacccttggacagccggcctccatgacctgcaagtccagtcaaagcctcgttcacagtgatggaaacacctacttgatttggtttcagcagaggccaggccaatctccaaggcgcctaatttataaggtgtctgaccgcgactctggggtcccagacagattcagcggcagtgggtcaggcactgatttcacactgaagatcagcagggtggaggctgaggatgttggggttattactgcatgcaaggtacacactggcccgtcaccttcggccaagggacacgactggagattaaacgaactgtggctgcacca

SEQ ID NO: 597546 - DNA, 444 bp, Homo sapiens
  misc_feature: HIJSMM301BR22R.5.9.A09.1.454.light.4.raw
atcagacacgcacgaccggtgctcgatttagcgagacgcgcagggtcctgggcccagtctgtggtgacgcagccgccctccgtttcttgggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctgttcccgccctcctccgtgtctgat

SEQ ID NO: 597547 - DNA, 485 bp, Homo sapiens; identical to SEQ ID NO: 570229
  misc_feature: HIJSMM301B11AN.47.60.F05.1.454.light.4.raw

SEQ ID NO: 597548 - DNA, 505 bp, Homo sapiens; identical to SEQ ID NO: 536254
  misc_feature: HIJSMM301AWOKB.7.71.G05.1.454.light.4.raw

SEQ ID NO: 597549 - DNA, 507 bp, Homo sapiens
  misc_feature: HIJSMM301CRLAC.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaacgcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggcccaaccccactgtca

SEQ ID NO: 597550 - DNA, 505 bp, Homo sapiens; identical to SEQ ID NO: 556957
  misc_feature: HIJSMM301B9726.15.86.H09.1.454.light.4.raw

SEQ ID NO: 597551 - DNA, 493 bp, Homo sapiens
  misc_feature: HIJSMM301DEU0E.14.53.E09.1.454.light.4.raw
cgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcaagtatgtctttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttagtcgggtgttcggcgggaggaccaagctggaccgtcctaggtcagtccaaggctcgcccccgttcggtccta

SEQ ID NO: 597552 - DNA, 502 bp, Homo sapiens
  misc_feature: HIJSMM301BXN26.51.59.F04.1.454.light.4.raw
cgatcgtatacacgaccggtgctcgatttagtacacacacttagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaagagccaccctctcctgcagggccagtgagagtattgacatcttcttggcctggtaccaacagaaacctggccaggctccccgactcctcatttatgatgcatccaaaagggtcgttggcatcccagccaggttcagtggcagtgggtctgggacagaattcactctcaccatcaccagactagagcctgaagattttgcagtttattactgtcagcagcgtaacaactggctctctttcggcggagggaccaaggtggagatcaaagaactgtggctgcaccatctgtcttcatcttcccgccat

SEQ ID NO: 597553 - DNA, 383 bp, Homo sapiens; identical to SEQ ID NO: 540698
  misc_feature: HIJSMM301CW9AZ.41.28.C06.1.454.light.4.raw

SEQ ID NO: 597554 - DNA, 494 bp, Homo sapiens
  misc_feature: HIJSMM301CQ55B.49.22.B11.1.454.light.4.raw
agtcgagagacacgaccggtgctcgatttagacgacagctcagggggaggaactgctcagttaggacccagagggaaccatggaagccccagctcagcttctcttcctcctgctactctggctcccagatatttccgaagaaattgtgttgacacagtctccagccaccctctatctgtctccaggggaaagagccaccctctcctgcagggccagtcagagtgttaacaacttcttaggctggtatcaacaaaaacctggccaggttcccaggctcctcgtctatgatgcgtccatcagggccactggcatcccagccaggttcagtggcagtgggtctgggacagacttcactctcaccatcagcagcctagagcctgaagactttgcagtttattactgtcagcagcgtagcaatttgatcaccttcggccaagggacacgactaggaaattaaacgaactgtggctgcaccatctgtcttcatctccgcc

SEQ ID NO: 597555 - DNA, 514 bp, Homo sapiens
  misc_feature: HIJSMM301ATG6X.4.21.B10.1.454.light.4.raw
agcactgtagcacgaccggtgctcgatttagtgtcgtcgcaagagagagagaggaggggggggctcaggaggcagagctctgggaatctcaccatggcctggacccctctcctgcctcccccctcctcactttctgcacagtctctgaggcctcctatgagctgacacagcccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcagtgggcccaagtggaggatgaagctgactactactgttactcaatagagaacagtgataatttctgggtgttcggcggagggaccaaactgacccgtcctaggtcagcccgaaggcctcgccccctcggtccactcc

SEQ ID NO: 597556 - DNA, 505 bp, Homo sapiens
  misc_feature: HIJSMM301E26DX.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaacgcccccaaactcatcatttatgatgccactaagcggccctcgaggggtttctaatcgcttctctggctccaagtctggcaacacggcctcctgacaatctctgggctccaggctgaggacgaggctgattactactgctgctcatatgcaggtcgtatctcttatgtcttcggaactgggaccaaggtcaccgtcctaggtcagcccaaggccaaccccatgtca

SEQ ID NO: 597557 - DNA, 446 bp, Homo sapiens; identical to SEQ ID NO: 536106
  misc_feature: HIJSMM301EH6BF.18.9.A09.1.454.light.4.raw

SEQ ID NO: 597558 - DNA, 491 bp, Homo sapiens
  misc_feature: HIJSMM301BZCV4.16.68.G02.1.454.light.4.raw
  modified_base (467)..(467): a, c, t, g, unknown or other
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaacngtggctgcaccatctgtcttcatt

SEQ ID NO: 597559 - DNA, 487 bp, Homo sapiens
  misc_feature: HIJSMM301EBERT.4.59.F04.1.454.light.4.raw
agcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcaccttctctggagataaattgggccataaatttgcttcctggtatcagcagaagccaggccagtcccctatactggtcatctatcaagataccaagcggccctcagggatccctgagcgattctctggctccaattctgggaacacagccactctgaccatcaccgggacccaggctgtagatgaggctgactattactgtcaggcgtgggacagcagcactgaggtgttcggcggagggaccaagctgaccgtcctacgtcagcccaaggctgcccctc

SEQ ID NO: 597560 - DNA, 495 bp, Homo sapiens
  misc_feature: HIJSMM301BX4HQ.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaacaccttcggccaagggacacgactggagattaaaggaactagtggctgcaccatcctgtcttcatcttccccg

SEQ ID NO: 597561 - DNA, 485 bp, Homo sapiens; identical to SEQ ID NO: 535985
  misc_feature: HIJSMM301BMMSG.15.1.A01.1.454.light.4.raw

SEQ ID NO: 597562 - DNA, 497 bp, Homo sapiens
  misc_feature: HIJSMM301ECWMS.13.87.H10.1.454.light.4.raw
tcacgtactacacgaccggtgctcgatttagcagtactgcgttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagacaaaaaccagggaaagtccctaagctcctgatctatgttgcatccactttgcaaagtggggtcccatcaaggttcagcggcagtggatctgggacagaattcactctcacaatcagcagcctgcagcctgaagattttgcaaacttattactgtcaaacagctttaaatagttacccgctcagttttcggcggagggaccaaagggtgagatacaaaacgaactgtggctgcaccatctgt

SEQ ID NO: 597563 - DNA, 494 bp, Homo sapiens
  misc_feature: HIJSMM301BC9VO.13.11.A11.1.454.light.4.raw
tcacgtactacacgaccggtgctcgatttagctacgactgcaggggggggtctcaggaggcagcgctctcaggacatctccaccatggcctgggctctgctgctcctcaccctcctcactcagggcacagggtcctgggcccagtctgccctgactcagcctgcctccgtgtctggctctcctggacagtcgatcatcgtctcctgcactggaaccagcactgatgttggtggttataactatgtctcctggtatcaacaacacccaggcaaagcccccaaactcatcatttatgaagtcatttatcggccctcagggatttctaatcgcttctctggctccaagtctggcaacacggcctccctgaccatctctgggctccaggctgaagacgaggctgattattactgcagctcatatacaaccatacaacacacaggtcttcggaagtgggaccaaagtcaccgtcctaggtcagcccaaggcccaaccca

SEQ ID NO: 597564 - DNA, 492 bp, Homo sapiens
  misc_feature: HIJSMM301EXC9V.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggaggaccaaggtggagatacaaacgaactgtggc

SEQ ID NO: 597565 - DNA, 494 bp, Homo sapiens
  misc_feature: HIJSMM301DVG19.40.53.E09.1.454.light.4.raw
tctagcgactcacgaccggtgctcgatttagagagagtgtgttgggtttgggggctggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttatttttgctgctcttatgcaggcagtttcgctctcgaagtgttcggcggagggaccgagctgaccgtcctacgtcagccaa

SEQ ID NO: 597566 - DNA, 489 bp, Homo sapiens; identical to SEQ ID NO: 543840
  misc_feature: HIJSMM301A0H9D.12.88.H11.1.454.light.4.raw

SEQ ID NO: 597567 - DNA, 499 bp, Homo sapiens; identical to SEQ ID NO: 540144
  misc_feature: HIJSMM301BB51O.47.66.F11.1.454.light.4.raw

SEQ ID NO: 597568 - DNA, 480 bp, Homo sapiens; identical to SEQ ID NO: 535291
  misc_feature: HIJSMM301ANX6Z.22.59.F04.1.454.light.4.raw

SEQ ID NO: 597569 - DNA, 483 bp, Homo sapiens
  misc_feature: HIJSMM301CVBEI.48.37.D04.1.454.light.4.raw
agtatacatacacgaccggtgctcgatttagtagcatactgttgggtttgggggtggtagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctctggggtccccgatcggttctctggctccatcgacaggtcctccaactctgcctctctcaccatctctggactgcagactgaggacgaggctgattactactgtcagtcttatgatagtggcaataatgtttgggtgtttggcggtagggaccaagctgaccgtct

SEQ ID NO: 597570 - DNA, 490 bp, Homo sapiens; identical to SEQ ID NO: 535234
  misc_feature: HIJSMM301DEFZ5.17.21.B10.1.454.light.4.raw

SEQ ID NO: 597571 - DNA, 499 bp, Homo sapiens
  misc_feature: HIJSMM301EFK6R.12.87.H10.1.454.light.4.raw
atacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcattgggggaaaagtttgctttctggtatcagcagaagccaggccagtcccctgtcttggtcatctataaggatagcaggcggccctcagggattcctgagcgattctccggctccaactccggcaacacagccactctgaccatcagcgggacccaggctctcgatgaggctgactattactgccaggcgtgggacagctccacttcccgttatcgtcttcggaggtgggaccatggtcaccgtcctaggtcagcccaagaccaaccccactcgt

SEQ ID NO: 597572 - DNA, 520 bp, Homo sapiens
  misc_feature: HIJSMM301EDQO2.9.86.H09.1.454.light.4.raw
tgatacgtctcacgaccggtgctcgatttagtgctatagacttgggtttgggggggggtcgacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatcaccatctcctgcactggaaccagcattgggagttttaaccttgtctcctggtaccaacaccacccaggcaaagcccccaaactcatgatttatgaagtcactaagcggccctcggggatttctgctcgcttctctggctccaagtccgtcaacacggcctccctgacaatctctgggctccagactgaggacgaggctcattattactgttgctcatatacaggtgtaagtagttgggtgttcggcggagggaccaagctgaccgtcctaggtcagcccaaggctgccccctcggtcactctgttcccaccctcct

SEQ ID NO: 597573 - DNA, 521 bp, Homo sapiens; identical to SEQ ID NO: 538715
  misc_feature: HIJSMM301AQ32B.27.23.C01.1.454.light.4.raw

SEQ ID NO: 597574 - DNA, 488 bp, Homo sapiens
  misc_feature: HIJSMM301CBB3L.52.83.H06.1.454.light.4.raw
cgcagtacgacacgaccggtgctcgatttagatcacgtgcgtcgcggggagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttggccgggcgagtcaggacattagcaattatttaaattggtatcagcagaaaccagggaaagcccctaaactcctgatctacgatgcatccaatttggaaacaggggtcccatcaaggttcagtggaagtggttctgggacactattttactttcaccatcagcggcctgcagcctgaagatattgcaacatattactgtcaacagtatggtaatctcccactcactttcggcggaggaccgaaggtcgagatcaaacgaactgtggctgcaccatctgtcttcatt

SEQ ID NO: 597575 - DNA, 482 bp, Homo sapiens; identical to SEQ ID NO: 535352
  misc_feature: HIJSMM301C2LMT.16.81.H04.1.454.light.4.raw

SEQ ID NO: 597576 - DNA, 486 bp, Homo sapiens; identical to SEQ ID NO: 537144
  misc_feature: HIJSMM301CKA0V.46.35.D02.1.454.light.4.raw

SEQ ID NO: 597577 - DNA, 496 bp, Homo sapiens; identical to SEQ ID NO: 535109
  misc_feature: HIJSMM301AF0UH.16.78.H01.1.454.light.4.raw

SEQ ID NO: 597578 - DNA, 522 bp, Homo sapiens
  misc_feature: HIJSMM301BVAPQ.40.46.E02.1.454.light.4.raw
tctagcgactcacgaccggtgctcgatttagactcatctacagggaaaggggctgggcctaaggaagcagcactggtggtgcctcagccatggcctggaccgttctcctcctcggcctcctctctcactgcacagggtctgtgacctcctatgtgctgactcagccactctcggtgtctgtggccccaggacaggcggccaatgttacctgtgggggagacaacattgggagtaaaagtgtgcactggtaccagctgaagccaggccaggcccctgtgttggtcgtctttggacatggtgcccgaccctcggggatccctgagcgattctctgcctccaggtctgggaacacggccaccctgaccatcaccagggtcgaggccggagatgaggccgactatttttgtcacgtgtggcacgttagtcatcacgtcttcggaactgggaccacggtcaccgtcctaagtcagcccaaggcccaaccccactgtcactctgttcccgccctcctcagtcgctaga

SEQ ID NO: 597579 - DNA, 529 bp, Homo sapiens
  misc_feature: HIJSMM301DF5IH.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccgaacgggaccgaacggtaggaaagtacgaaacgaaactacggtggtcgtcggtcaccaactctcgttcgtttcctattccttccccg

SEQ ID NO: 597580 - DNA, 509 bp, Homo sapiens; identical to SEQ ID NO: 547302
  misc_feature: HIJSMM301EN3FR.4.57.F02.1.454.light.4.raw

SEQ ID NO: 597581 - DNA, 478 bp, Homo sapiens
  misc_feature: HIJSMM301DBH3Z.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcggacccaggctatggatgaggctgactattactgtcaggcgtgggacatcagcagtgaggtggttttcggcggagggaccaagctgaccgtcctaagtcagacccg

SEQ ID NO: 597582 - DNA, 506 bp, Homo sapiens
  misc_feature: HIJSMM301B8TQN.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggtctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccaaggtggagatcaaacgaactgtggctgcaccatctgtt

SEQ ID NO: 597583 - DNA, 519 bp, Homo sapiens
  misc_feature: HIJSMM301ANEVW.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggccagcgctggcccctgctgctgctgggtctggccatggtcgcccatggcctgctgcgcccaatggttgcaccgcaaagcggggacccagaccctggaggcctcagttggaagcagccgatccagcctgcggagcctgtgggcaggtcagcccaaggctgccccctcggtcactctgttcccaccctcctccacg

SEQ ID NO: 597584 - DNA, 506 bp, Homo sapiens
  misc_feature: HIJSMM301CU2QF.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtctgggacagacttcactctcaccatcagcagcctagagcctgaagattttgcagtttattactgtcaacatcgtaccgagtggcctccggggccacttcggccctgggaccaaattgagatcaaacgaactgtggctgcaccatctgtcttctat

SEQ ID NO: 597585 - DNA, 481 bp, Homo sapiens; identical to SEQ ID NO: 535993
  misc_feature: HIJSMM301DM0AE.21.25.C03.1.454.light.4.raw

SEQ ID NO: 597586 - DNA, 494 bp, Homo sapiens
  misc_feature: HIJSMM301ERRNA.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatcctgcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtcctaggtcagcccaagg

SEQ ID NO: 597587 - DNA, 485 bp, Homo sapiens
  misc_feature: HIJSMM301A64IW.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcgatcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccaaactgaccgtcctaggtcagcccaaggctgccccctcggtcactctgttcccgccctcctctacgtgagct

SEQ ID NO: 597588 - DNA, 487 bp, Homo sapiens
  misc_feature: HIJSMM301EYXY6.52.34.D01.1.454.light.4.raw
cgcagtacgacacgaccggtgctcgatttagatcgtctgtgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacggtatccctgatcgcttctcaggctccggctctgggactgagcgctacctcaccatctccagccctccagtctgaggacgagggtgactattactgtcagacgtgggacactggcagtttgggtgttcggcggagggaccaagttgaccgtcctaggtcagcccaaggctcg

SEQ ID NO: 597589 - DNA, 521 bp, Homo sapiens; identical to SEQ ID NO: 539470
  misc_feature: HIJSMM301AVNXR.27.23.C01.1.454.light.4.raw

SEQ ID NO: 597590 - DNA, 377 bp, Homo sapiens
  misc_feature: HIJSMM301AK34M.40.9.A09.1.454.light.4.raw
tctagcgactcacgaccggtgctcgatttagcgagacgcgcagggggagctacaacaggcaggcaggggcagcaagatggtgttgcagacccaggtcttcatttctctgttgctctggatctcgggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcacca

SEQ ID NO: 597591 - DNA, 512 bp, Homo sapiens
  misc_feature: HIJSMM301ARM4X.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtaggacctcaaacgaaactagtggctgcaccatctgtcttcatcttcccgtccact

SEQ ID NO: 597592 - DNA, 491 bp, Homo sapiens
  misc_feature: HIJSMM301BRSST.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacacgtacccccctcactttcggcggaggaccgaaggacggagatcagacgaactgtggctgcaccatctgtcttcta

SEQ ID NO: 597593 - DNA, 489 bp, Homo sapiens
  misc_feature: HIJSMM301C45B7.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtgggtcccgtcaaggttcagtggcagtggatctgggacagatttcactctcaccatccgcggtctgcaacctgaagatttcgcaacttactactgtcaacagacttacagtgcccccccgatcaccttcggccaagggacacgactggagattaaacgaactgtggctgcaccatctgtcttcat

SEQ ID NO: 597594 - DNA, 434 bp, Homo sapiens; identical to SEQ ID NO: 535153
  misc_feature: HIJSMM301EE32N.18.5.A05.1.454.light.4.raw

SEQ ID NO: 597595 - DNA, 502 bp, Homo sapiens; identical to SEQ ID NO: 537363
  misc_feature: HIJSMM301AXSPA.18.23.C01.1.454.light.4.raw

SEQ ID NO: 597596 - DNA, 484 bp, Homo sapiens; identical to SEQ ID NO: 591924
  misc_feature: HIJSMM301D4IY4.43.87.H10.1.454.light.4.raw

SEQ ID NO: 597597 - DNA, 515 bp, Homo sapiens
  misc_feature: HIJSMM301CYI3I.40.46.E02.1.454.light.4.raw
tctagcgactcacgaccggtgctcgatttagactcatctacagggaaaggggctgggcctaaggaagcagcactggtggtgcctcagccatggcctggaccgttctcctcctcggcctcctctctcactgcacagggtctgtgacctcctatgtgctgactcagccactctcggtgtctgtggccccaggacaggcggccaatgttacctgtgggggagacaacattgggagtaaaagtgtgcactggtaccagctgaagccaggccaggcccctgtgttggtcgtctttggacatggtgcccgaccctcggggatccctgagcgattctctgcctccaggtctgggaacacggccacctgaccatcaccagggtcgaggccggagatgaggccgactattttgtcacgtgtggcacgttagtcatcacgtcttcggaactgggaccacggtcaccgtcctaagtcagcccaaggccaacccactgtcactctgttcccgccctcctcagtcgct

SEQ ID NO: 597598 - DNA, 486 bp, Homo sapiens; identical to SEQ ID NO: 537144
  misc_feature: HIJSMM301B7ETF.46.35.D02.1.454.light.4.raw

SEQ ID NO: 597599 - DNA, 502 bp, Homo sapiens; identical to SEQ ID NO: 541971
  misc_feature: HIJSMM301ERXGR.4.39.D06.1.454.light.4.raw

SEQ ID NO: 597600 - DNA, 520 bp, Homo sapiens; identical to SEQ ID NO: 538570
  misc_feature: HIJSMM301B3SHR.27.23.C01.1.454.light.4.raw

SEQ ID NO: 597601 - DNA, 488 bp, Homo sapiens; identical to SEQ ID NO: 535990
  misc_feature: HIJSMM301DIOXC.11.28.C06.1.454.light.4.raw

SEQ ID NO: 597602 - DNA, 493 bp, Homo sapiens; identical to SEQ ID NO: 537281
  misc_feature: HIJSMM301DWH14.9.1.A01.1.454.light.4.raw

SEQ ID NO: 597603 - DNA, 483 bp, Homo sapiens
  misc_feature: HIJSMM301DROD9.15.49.E05.1.454.light.4.raw
tctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgctagtttattactgtcagcagtataatgactggcctccgacgttcggcaaggaccaagtggaatcaacgaactgtggctgcacat

SEQ ID NO: 597604 - DNA, 510 bp, Homo sapiens
  misc_feature: HIJSMM301AGRJG.21.87.H10.1.454.light.4.raw
tcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaaactcttaatttctggcgtcaatcagcgaccctcacatgtttccagtcgattctctgcatccaagtctggcaacacggcctttctgacaatctctcaactccaggctgaagacgaggctatttattactgctcctcatacgcaggtggcactatttttcttggtttttggcggtcgggacccagatgactgtcctcagtcagcccaaggctcgccccctcggt

SEQ ID NO: 597605 - DNA, 494 bp, Homo sapiens; identical to SEQ ID NO: 559643
  misc_feature: HIJSMM301EQ2J7.27.78.H01.1.454.light.4.raw

SEQ ID NO: 597606 - DNA, 510 bp, Homo sapiens
  misc_feature: HIJSMM301AGGGT.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggccggggaccgaccgtggaaatacaaacgaactagtggctgcaccatctgtctt

SEQ ID NO: 597607 - DNA, 404 bp, Homo sapiens; identical to SEQ ID NO: 535779
  misc_feature: HIJSMM301A1UZE.4.35.D02.1.454.light.4.raw

SEQ ID NO: 597608 - DNA, 515 bp, Homo sapiens
  misc_feature: HIJSMM301AF37F.17.33.C11.1.454.light.4.raw
cgtagactagcacgaccggtgctcgatttagagtgagctcgttgggtttgggggcggccaggggtcccttccaataatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccgccctcct

SEQ ID NO: 597609 - DNA, 489 bp, Homo sapiens
  misc_feature: HIJSMM301BCXS6.12.51.E07.1.454.light.4.raw
  modified_base (406)..(406): a, c, t, g, unknown or other
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtgggtcccatcaaggttcagcggcagtgggtctgggacagaattcactctcaccatcagcagcctgcaacctgatgactttgcaacttnttactgccaacagtataatggttatgaatccacttttggccaagggaccaagctggagatcaaacgaactgtggctgcaccta

SEQ ID NO: 597610 - DNA, 516 bp, Homo sapiens
  misc_feature: HIJSMM301AHYWN.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgacgtggcctccgggggccgaccttcgtccgtcggtaccggaacgtaggagtagtacgtaacaaacgtaactacgtagtcgtcgccac

SEQ ID NO: 597611 - DNA, 504 bp, Homo sapiens; identical to SEQ ID NO: 535495
  misc_feature: HIJSMM301AU317.14.86.H09.1.454.light.4.raw

SEQ ID NO: 597612 - DNA, 509 bp, Homo sapiens; identical to SEQ ID NO: 539359
  misc_feature: HIJSMM301BBOBR.47.85.H08.1.454.light.4.raw

SEQ ID NO: 597613 - DNA, 507 bp, Homo sapiens
  misc_feature: HIJSMM301A8IDG.10.29.C07.1.454.light.4.raw
catagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttttgatgtcagtaatcggccctcaggggtttctaatcgcttctctggctccaagtctggcaacacggcctccctgaccatctctgggctccaggctgaggacgaggctgattattactgcagctcatatacaaccagcagcacttctgtattcggcggagggaccaagctgaccgtcctaggtcagcccaaggcctgccccctcggtcta

SEQ ID NO: 597614 - DNA, 506 bp, Homo sapiens; identical to SEQ ID NO: 534969
  misc_feature: HIJSMM301A4V5J.18.37.D04.1.454.light.4.raw

SEQ ID NO: 597615 - DNA, 501 bp, Homo sapiens; identical to SEQ ID NO: 535746
  misc_feature: HIJSMM301BW5PB.18.11.A11.1.454.light.4.raw

SEQ ID NO: 597616 - DNA, 498 bp, Homo sapiens
  misc_feature: HIJSMM301C8KDO.2.76.G10.1.454.light.4.raw
  modified_base (461)..(461): a, c, t, g, unknown or other
acgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgacccccaaactcctcatctctcacaataatcagcggccctcaggagtccctgaccgattctctgcctccaagtccggcacctcagcctccctggccatcagtggctccgggccgaggatgaggctgattattactgtgcaggatgggatgacaacctgggtncttatctcttcggacctgggaccaaggtcaccgtctt

SEQ ID NO: 597617 - DNA, 507 bp, Homo sapiens
  misc_feature: HIJSMM301EU668.48.74.G08.1.454.light.4.raw
agtatacatacacgaccggtgctcgatttagtagctctatcaggggaggattcaggacaatctccagcatggccggcttccctctcctcctcaccctcctcactcactgtacagggtcctgggcccagtctgtgctgactcagccaccctcagcgtctgggacccccggacagagggtcaccatctcttgttctggaagcagttccaacatcggaagtaattctgtattctggtaccagcagctcccaggatcggcccccaaacttgctcatctatatgaataatcaacggccctttgggtccctgaccgattctctggctccaagtctgacacctcagcctccctggccatcagtgggctccggtccgaggatgaggctgattattactgtgcagcatgggatgacagtcatgttgcttttcggcggagggaccaaggtgaccgtcctaggtcagcccaaggctgccccctcggtcactctgttcccgcctcctctatgtatactc

SEQ ID NO: 597618 - DNA, 502 bp, Homo sapiens
  misc_feature: HIJSMM301DNSR9.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctggtcagccaaggctgccccctcggtca

SEQ ID NO: 597619 - DNA, 497 bp, Homo sapiens
  misc_feature: HIJSMM301A0XBM.41.53.E09.1.454.light.4.raw
tctatactatcacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggaggaccaagctgaccgtcctaggtcagcccaaggctcg

SEQ ID NO: 597620 - DNA, 512 bp, Homo sapiens; identical to SEQ ID NO: 537564
  misc_feature: HIJSMM301EKYC1.17.33.C11.1.454.light.4.raw

SEQ ID NO: 597621 - DNA, 510 bp, Homo sapiens
  misc_feature: HIJSMM301AONX5.48.48.E04.1.454.light.4.raw
agtatacatacacgaccggtgctcgatttagagagcgtcacagagagaagggggggaagcctgagaacacttagccttcatgagtgtccccaccatggcctggatgatgcttctcctcggactccttgcttatggatcaggcgtgcattctcagagtgtggtgacccaggaaccatcgttctcagtgtcccctggagggacagtcacactcacttgtggcttgacttctggctcagtcgcgccggtccactaccccagttggtaccaacagatcccaggccaggctccacgcacgctcatcttcatgaaacagattcgctcttctggggtccctgatcggttttctggctccatcgttgggggcaaagccgccctcaccatcacgggggcccaggcagaggatgaggcgaattattattgtatgctccacaggggcaggggcacctgggagttcggcggcgggaccaagctgaccgtcctaggtcagcccaaggctgccccctcggtcta

SEQ ID NO: 597622 - DNA, 460 bp, Homo sapiens; identical to SEQ ID NO: 536053
  misc_feature: HIJSMM301ARSFE.22.28.C06.1.454.light.4.raw

SEQ ID NO: 597623 - DNA, 481 bp, Homo sapiens; identical to SEQ ID NO: 535993
  misc_feature: HIJSMM301EZ68D.21.25.C03.1.454.light.4.raw

SEQ ID NO: 597624 - DNA, 486 bp, Homo sapiens
  misc_feature: HIJSMM301BS1RK.19.71.G05.1.454.light.4.raw
tactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttatattgtcaacaatattattatacttcgtggacgttcggccaagggaccaaggtggataatcagacgaa

SEQ ID NO: 597625 - DNA, 489 bp, Homo sapiens; identical to SEQ ID NO: 535139
  misc_feature: HIJSMM301CJDNH.14.55.E11.1.454.light.4.raw

SEQ ID NO: 597626 - DNA, 494 bp, Homo sapiens; identical to SEQ ID NO: 534994
  misc_feature: HIJSMM301EFBLY.27.78.H01.1.454.light.4.raw

SEQ ID NO: 597627 - DNA, 478 bp, Homo sapiens
  misc_feature: HIJSMM301AF3XV.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactaactttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggccctgggactgaagtgcatatgaagagaactgtggctgca

SEQ ID NO: 597628 - DNA, 497 bp, Homo sapiens; identical to SEQ ID NO: 535829
  misc_feature: HIJSMM301AFBPN.5.24.C02.1.454.light.4.raw

SEQ ID NO: 597629 - DNA, 501 bp, Homo sapiens; identical to SEQ ID NO: 536142
  misc_feature: HIJSMM301C11HX.15.1.A01.1.454.light.4.raw

SEQ ID NO: 597630 - DNA, 521 bp, Homo sapiens; identical to SEQ ID NO: 539470
  misc_feature: HIJSMM301BLFRQ.27.23.C01.1.454.light.4.raw

SEQ ID NO: 597631 - DNA, 508 bp, Homo sapiens
  misc_feature: HIJSMM301BI0MS.12.73.G07.1.454.light.4.raw
atacgacgtacacgaccggtgctcgatttagctctacgctcaggggctgggcccaaggaagcagcactggtggtgcctcagccatggcctggaccgttctcctcctcggcctcctctctcactgcacagcctctgtgacctcctatgtactgattcagtcgccctcggtgtcagtggccccaggacagacggccacgattacctgtggaggagacaatattgtcaccaaaagtgttcactggtaccagcagaagccaggccaggcccctgtggtggtcgtctatgatgatagcgaccggccctcggggatccctgagcgattctctggctccaactctgggaacatggccaccctgaccatccgcagggtcgaggccggggatgaggccgactattattgtcaggtgtgggataatggcagtgatcatgtcttattcggcggagggaccacgctgaccgtcctaagtcagcccaaggctgccccctcggtccactctgttcccgccct

SEQ ID NO: 597632 - DNA, 492 bp, Homo sapiens
  misc_feature: HIJSMM301A5A4X.43.29.C07.1.454.light.4.raw
tgtgagtagtcacgaccggtgctcgatttagagtgctacgaagggaaagggggaggtcagacccactcaggacacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtggggtcccatcaagattcagcggtagtggatctgggacagaattcactctcaccgtcagcagcctgcagcctgaagattttgcaacttattactgccaacaatatgattcttggccgtggacgtcggtccaaggaccaacgtggaaagtacaaacgaactagtggctgcacatctgtctt

SEQ ID NO: 597633 - DNA, 524 bp, Homo sapiens
  misc_feature: HIJSMM301ALWBS.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctggtggggcaggtcagccccaaggcccaaccccactcgtcactcttccg

SEQ ID NO: 597634 - DNA, 504 bp, Homo sapiens; identical to SEQ ID NO: 585316
  misc_feature: HIJSMM301D4V28.17.27.C05.1.454.light.4.raw

SEQ ID NO: 597635 - DNA, 509 bp, Homo sapiens
  misc_feature: HIJSMM301BWCCN.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctctaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactctgtt

SEQ ID NO: 597636 - DNA, 508 bp, Homo sapiens; identical to SEQ ID NO: 552440
  misc_feature: HIJSMM301BB3WJ.5.24.C02.1.454.light.4.raw

SEQ ID NO: 597637 - DNA, 505 bp, Homo sapiens; identical to SEQ ID NO: 545964
  misc_feature: HIJSMM301A6TEM.10.12.B01.1.454.light.4.raw

SEQ ID NO: 597638 - DNA, 492 bp, Homo sapiens; identical to SEQ ID NO: 567797
  misc_feature: HIJSMM301DE0HI.41.72.G06.1.454.light.4.raw

SEQ ID NO: 597639 - DNA, 447 bp, Homo sapiens; identical to SEQ ID NO: 535020
  misc_feature: HIJSMM301BQ98Q.18.9.A09.1.454.light.4.raw

SEQ ID NO: 597640 - DNA, 517 bp, Homo sapiens
  misc_feature: HIJSMM301A8DG5.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccgaaggaccgaacggaggaagtacgaaacgaactacgtaggcgtgcaccactactgtcttctactcttcccgtccact

SEQ ID NO: 597641 - DNA, 514 bp, Homo sapiens; identical to SEQ ID NO: 545978
  misc_feature: HIJSMM301C7V6D.17.33.C11.1.454.light.4.raw

SEQ ID NO: 597642 - DNA, 507 bp, Homo sapiens
  misc_feature: HIJSMM301BB8H1.47.85.H08.1.454.light.4.raw
agctcacgtacacgaccggtgctcgatttagtatcactcagtccgccggggctgggtctcaggaggcagcgcgtctcaggaacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctcctgaccatctctgggctcgagtctgaggacgaggctgattacttctgttgctcttgggcaactctgtcgtttgggtgttcggcggagggaccaagttgaccgtcctaggtcagcccaaggctgccccctcggtcact

SEQ ID NO: 597643 - DNA, 521 bp, Homo sapiens; identical to SEQ ID NO: 539470
  misc_feature: HIJSMM301EBRHC.27.23.C01.1.454.light.4.raw

SEQ ID NO: 597644 - DNA, 481 bp, Homo sapiens; identical to SEQ ID NO: 535993
  misc_feature: HIJSMM301A6CI0.21.25.C03.1.454.light.4.raw

SEQ ID NO: 597645 - DNA, 489 bp, Homo sapiens; identical to SEQ ID NO: 535139
  misc_feature: HIJSMM301ED3AJ.14.55.E11.1.454.light.4.raw

SEQ ID NO: 597646 - DNA, 490 bp, Homo sapiens; identical to SEQ ID NO: 535234
  misc_feature: HIJSMM301A6JWD.17.21.B10.1.454.light.4.raw

SEQ ID NO: 597647 - DNA, 476 bp, Homo sapiens
  misc_feature: HIJSMM301BU6SR.40.85.H08.1.454.light.4.raw
tctagcgactcacgaccggtgctcgatttagtatcactcagtcgcgggggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcacttgccgggcaagtcaggacattaaaagtgatttgggctggtatcagcagaaaccagggagagcccctaagctcctcatctatgctgcatccactttacaaagtggagtcccatcaaggttcagcggcagtggatctggcacagatttcactctcaccatcagcagcctgcagcctgaagattttgcaacttattattgtctacacgactacagttaccctcggacattcggccaagggaccaaggtggaaatcaaacgaactgtggctgca

SEQ ID NO: 597648 - DNA, 497 bp, Homo sapiens
  misc_feature: HIJSMM301AOC2P.5.24.C02.1.454.light.4.raw
atcagacacgcacgaccggtgctcgatttagtacagatcgttagggaaagggggctggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtccagccc

SEQ ID NO: 597649 - DNA, 484 bp, Homo sapiens; identical to SEQ ID NO: 535400
  misc_feature: HIJSMM301DGKLT.46.26.C04.1.454.light.4.raw

SEQ ID NO: 597650 - DNA, 488 bp, Homo sapiens
  misc_feature: HIJSMM301BB3IU.4.64.F09.1.454.light.4.raw
agcactgtagcacgaccggtgctcgatttagcgcgtatacaaggggggagtcagacccagtcaggacacagcgtggacatgagggtccccgctcagctcctggggctcctgctgctctggttcccaggttccagatgcgacatccagatgacccagtctccatcttccgtgtctgcatctgtgggcgacagagtcaccatcacttgtcgggcgagtcaggacattgggacccgattagcctggtatcagcagaaaccagggaaagcccctaacctcctcatctatgctgcgtccagtttgcacagtggggtcccattgaggttcagcggcagtggttctgagacagatttcagtctcaccatccgtgacctgcagcctgaagattttgcaacttacttttgtcaacagactaactcattccctcgcagttttggccaggggaccaaggtggagatcagacgaactgtggctgcaccatctgtcttcta

SEQ ID NO: 597651 - DNA, 507 bp, Homo sapiens
  misc_feature: HIJSMM301EKEDW.9.71.G05.1.454.light.4.raw
tgatacgtctcacgaccggtgctcgatttagtgtcgtcgcaagagagagggggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcgggggaccaggctgaccgtcctgagtcagcccaaggctgccccctcggtcactctgttcccgccctcctcacgtacg

SEQ ID NO: 597652 - DNA, 480 bp, Homo sapiens
  misc_feature: HIJSMM301BD6I3.48.28.C06.1.454.light.4.raw
agtatacatacacgaccggtgctcgatttagagctcacgtattgggtttggggggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagcccaaggcc

SEQ ID NO: 597653 - DNA, 505 bp, Homo sapiens; identical to SEQ ID NO: 562477
  misc_feature: HIJSMM301BC10B.16.49.E05.1.454.light.4.raw

SEQ ID NO: 597654 - DNA, 472 bp, Homo sapiens
  misc_feature: HIJSMM301CFXA0.15.81.H04.1.454.light.4.raw
tctacgtagccacgaccggtgctcgatttagtagtgtagattcgcggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgcccctcggtcactctgttccaccctcctcgctacgtaga

SEQ ID NO: 597655 - DNA, 516 bp, Homo sapiens
  misc_feature: HIJSMM301APJ0Q.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtaggacctcaaacgaaactgtggctgcaccaatctgtcttctatcttccccgtcccactt

SEQ ID NO: 597656 - DNA, 501 bp, Homo sapiens
  misc_feature: HIJSMM301CF5GW.48.36.D03.1.454.light.4.raw
agtatacatacacgaccggtgctcgatttagctgcgtcacgatctctcttgggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttcaagtttcctttttgtcttcggaactgggaccgaggtcaccgtcctaggtcagcccaaggccaacccca

SEQ ID NO: 597657 - DNA, 498 bp, Homo sapiens
  misc_feature: HIJSMM301D4G95.19.67.G01.1.454.light.4.raw
tactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagccttgtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagtttattactgtcagcaattatttttcttatcctccgtggacgttcgcaggacaggtgaaatcagacgaactgtggctgcaccat

SEQ ID NO: 597658 - DNA, 499 bp, Homo sapiens
  misc_feature: HIJSMM301BNHTF.48.31.C09.1.454.light.4.raw
agtatacatacacgaccggtgctcgatttagacgtctcatcaaggaaggaagggggcaggagtcagtctcagtcaggacacagcatggacatgggggtccccgctcagctcctggggctcctgctactctggctccgaggtgccagatgtgacatccagctgacccagtctccatcctccctgtctgcttctgtgggagacagagtcaccatcacttgccgggcaagtcagaacattggcgattacttcaattggtatcagcagaaaccagggaaagcccctaaactcttaatctacactgcagcccggttgcaaagtggagtcccatcaaggttcagtggcaatggatccgggacagattttcggctcaccatcagcagtctacaacctgaagattttgcaacctactctgtcaccaggcttacaattcccctccgacgttcggccaagggaccaaggtggaagtcagacgaactgtggctgcaccatctgtcttcta

SEQ ID NO: 597659 - DNA, 502 bp, Homo sapiens; identical to SEQ ID NO: 559752
  misc_feature: HIJSMM301CPL5K.2.35.D02.1.454.light.4.raw

SEQ ID NO: 597660 - DNA, 504 bp, Homo sapiens
  misc_feature: HIJSMM301DFUUG.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgggtcagcccaaggctgccccctcggtcactctgttcccacctcctctacgtcgtat

SEQ ID NO: 597661 - DNA, 496 bp, Homo sapiens; identical to SEQ ID NO: 535541
  misc_feature: HIJSMM301CVRV6.3.33.C11.1.454.light.4.raw

SEQ ID NO: 597662 - DNA, 506 bp, Homo sapiens
  misc_feature: HIJSMM301BQNB3.14.3.A03.1.454.light.4.raw
cgtctagtaccacgaccggtgctcgatttagagagcgtcacaggggggggtcgtcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaagcccccaaatcattatttatgaggtcaataatcggccctcaggagtttctaatcgcttctctggctccaagtctggcaacacggcctccctgagcatctctgggctccaggctgaggacgaggctgattattactgcagctcatatactattagcagaactgtggttttcggcggtagggaccaaggtgaccgtcctaggtcagcccaaggctgccccctcggtcactctcg

SEQ ID NO: 597663 - DNA, 495 bp, Homo sapiens; identical to SEQ ID NO: 536931
  misc_feature: HIJSMM301EP205.10.33.C11.1.454.light.4.raw

SEQ ID NO: 597664 - DNA, 511 bp, Homo sapiens
  misc_feature: HIJSMM301BHG3N.49.87.H10.1.454.light.4.raw
agtcgagagacacgaccggtgctcgatttagcagtactgcgttgggtttgggggtgggtccaggaggcagaactctgggtgtctcaccatggcctggatccctctacttctccccctcctcactctctgcacaggctctgaggcctcctatgagttgatccagccaccctcggtgtcagtgtccccaggacagacggccaggattctttgctctggagatgcgttggcaaaacagtttgcttattggttccagcagaagccaggccaagcccctgtggtggtgatttataaaggctttcagaggccctcagggatccctgagcgattctctgggtccagctcagggacaacagccatgttgaccatcagtggagtccaggcagaagacgaggctgactattattgtcaatcagcagacaacactgttgtttctgtgtttttcggcggcgggaccgaggctgaccgtcctgggtcagcccaaggctgccccctccggtcactctgttcccta

SEQ ID NO: 597665 - DNA, 470 bp, Homo sapiens
  misc_feature: HIJSMM301EUIR1.40.10.A10.1.454.light.4.raw
tctagcgactcacgaccggtgctcgatttagcgtcgatctcagggggcaggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggtccaggggaccgaaacgtaggatgtcaaccgaa

SEQ ID NO: 597666 - DNA, 484 bp, Homo sapiens
  misc_feature: HIJSMM301BJI7L.3.46.E02.1.454.light.4.raw
agacgcactccacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggcaccctgtctgtgtctccaggggaaagagccacgctctcctgtagggccagtcagagtgtcagacataatttaggctggtaccaacagaaacctggccaggctcccaggctcctcattcatggtgcatctaacagggccgatggcattccagccaggttcagtggcagtggatatgggacagacttcactctcaccatcagcaatctgcagtctgaagattttgcagtttatttctgtcagcagtttaacactggcctggaagttttggccaggggaccaagctggagctcaaacgaactgtggctgcaccat

SEQ ID NO: 597667 - DNA, 505 bp, Homo sapiens; identical to SEQ ID NO: 582289
  misc_feature: HIJSMM301AZSYI.15.66.F11.1.454.light.4.raw

SEQ ID NO: 597668 - DNA, 492 bp, Homo sapiens
  misc_feature: HIJSMM301CTGFD.16.86.H09.1.454.light.4.raw
tgtactactccacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtcctaggtcagcccaaggct

SEQ ID NO: 597669 - DNA, 510 bp, Homo sapiens; identical to SEQ ID NO: 564704
  misc_feature: HIJSMM301EOTCZ.8.42.D09.1.454.light.4.raw

SEQ ID NO: 597670 - DNA, 507 bp, Homo sapiens; identical to SEQ ID NO: 538063
  misc_feature: HIJSMM301BEETW.47.85.H08.1.454.light.4.raw

SEQ ID NO: 597671 - DNA, 505 bp, Homo sapiens
  misc_feature: HIJSMM301BGUU1.16.9.A09.1.454.light.4.raw
tgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctggagataacctgggaagtaaatttactttctggtatcagcggaagccaggccagtcccctgttttggtcatctataaagataggaatcggccctcagacatccctgagcgattatctggctccagctctggaaacacagccactctgaccatcaccgggacccagactatggatgaagctgactattactgtcaggcgtgggacagcggcactgtggttttcggtcggagggaccaagctgaccgtcctcggtcagcccaaggctgccccctcggtcactctgttcccgccctccc

SEQ ID NO: 597672 - DNA, 493 bp, Homo sapiens
  misc_feature: HIJSMM301DH03U.41.38.D05.1.454.light.4.raw
tctatactatcacgaccggtgctcgatttagtatctgatagttgggttggggaggagccagacccagtcaggacacagcatggacatgagggtccccgctcagctcctggggctcctgctgctctggttcccaggttccagatgcgacatccagatgacccagtctccatcttctgtgtctgcatctgtcggagacagagtcaccatcacttgtcgggcgagtcagggtattggcagctacttagtctggtatcaacaaaaaccagggaaagcccctaaactccttatttatggatcatccagtttacaaagtggggtcccatcaaggttcagcggcagtggatctgggacacatttcactctcactatcagcagcctgcagcctgaggattttgcgacttactattgtcaacaggctgacagtttccctctcactttcggcggagggaccaaggttgagaccaaacgaactgtggctgcaccatctgtcttc

SEQ ID NO: 597673 - DNA, 501 bp, Homo sapiens
  misc_feature: HIJSMM301D2RK5.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtctgcgtcagcccaaggctgccccctggtcacttc

SEQ ID NO: 597674 - DNA, 497 bp, Homo sapiens
  misc_feature: HIJSMM301CILAU.15.25.C03.1.454.light.4.raw
tctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttggttctaatcgggcctccggggtccctgacaggttcagtggcagtggatcaggcatagattttacactgaaaatcagcagagtggaggctgaggacgttggggtttattactgcatgcaaggtctacaaaccccgatcaccttcggccgagggacacgcctggagattaaacgaactgtggctgcaccat

SEQ ID NO: 597675 - DNA, 499 bp, Homo sapiens; identical to SEQ ID NO: 568292
  misc_feature: HIJSMM301B22II.52.78.H01.1.454.light.4.raw

SEQ ID NO: 597676 - DNA, 516 bp, Homo sapiens
  misc_feature: HIJSMM301CV4IF.22.36.D03.1.454.light.4.raw
acatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccactcatcatttatggtgtcactcgtcggccctcaggagtctctcatcgcttctcaggctccaagtctggcaacacggcctccctaaccatctctgggcgtccagtttgaggacgagtctacttattactgcagttcctttaaattaggcgccactctcgtggttttcggtcggaggcgaccgaagtgaccgtccctcggtcagcccaaggctgccccctccggtcact

SEQ ID NO: 597677 - DNA, 519 bp, Homo sapiens
  misc_feature: HIJSMM301C8U0P.10.38.D05.1.454.light.4.raw
catagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttggcggcgggactaaggtgaccgtcctgggtcagcccaaggctgccccctcggtcactctcgttcccaccct

SEQ ID NO: 597678 - DNA, 492 bp, Homo sapiens
  misc_feature: HIJSMM301ADETL.48.65.F10.1.454.light.4.raw
agtatacatacacgaccggtgctcgatttagctacgctctaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgaggacagtaagcggccctcaggggtttctaatcgcttctctggctccaagtctggcaacacggcctccctgacaatctctgggctccaggctgaggacgaggctgattattactgctgctcatatgcagatagtagcactcatgtggtattcggcggagggaccaagctgaccgtcctaggtcagcccaaggctccg

SEQ ID NO: 597679 - DNA, 506 bp, Homo sapiens
  misc_feature: HIJSMM301DPBJ3.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacaagcctctctgaccattactggtctccagcctgacgacgaggctgactactactgctcagcctgggacaccagcctcgctgcttggcttttcggcggagggaccaagctgaccgtcctgggtcagcccaaggctgccccctcggtcta

SEQ ID NO: 597680 - DNA, 514 bp, Homo sapiens
  misc_feature: HIJSMM301BXHF4.22.36.D03.1.454.light.4.raw
acatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaacccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaattaggcgccactctcgtggttttcggcggaggcaccgaagtgaccgtcctcggtcagcccaaggctgccccctcggtcactc

SEQ ID NO: 597681 - DNA, 486 bp, Homo sapiens; identical to SEQ ID NO: 535043
  misc_feature: HIJSMM301BI3PK.46.35.D02.1.454.light.4.raw

SEQ ID NO: 597682 - DNA, 464 bp, Homo sapiens; identical to SEQ ID NO: 587762
  misc_feature: HIJSMM301DYXIZ.11.73.G07.1.454.light.4.raw

SEQ ID NO: 597683 - DNA, 484 bp, Homo sapiens; identical to SEQ ID NO: 535240
  misc_feature: HIJSMM301BUM5Y.47.60.F05.1.454.light.4.raw

SEQ ID NO: 597684 - DNA, 490 bp, Homo sapiens; identical to SEQ ID NO: 543909
  misc_feature: HIJSMM301CYVMX.14.55.E11.1.454.light.4.raw

SEQ ID NO: 597685 - DNA, 503 bp, Homo sapiens; identical to SEQ ID NO: 535044
  misc_feature: HIJSMM301EL62K.19.78.H01.1.454.light.4.raw

SEQ ID NO: 597686 - DNA, 495 bp, Homo sapiens
  misc_feature: HIJSMM301ECP42.51.69.G03.1.454.light.4.raw
cgatcgtatacacgaccggtgctcgatttagtcgctgcgtaaaggagaaaggggctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaccttatgatgtacactggtaccaacaacttccaggagcagcccccaaactcctcatctttggtaacaacaatcggccctcaggggtccctgaccgattctctggctccaggtctggcacctcagcctccctggccatcactgggctccaggctgaggatgagggtgattattactgccagtcctatgacagcggcctcagttatttggtggtgttcggcggagggaccaaggtgaccggtcct

SEQ ID NO: 597687 - DNA, 480 bp, Homo sapiens
  misc_feature: HIJSMM301EZ0XP.40.23.C01.1.454.light.4.raw
tctagcgactcacgaccggtgctcgatttagtacacgtgattagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggtcggagggaccaagctgaccgtcctaagtcagccccg

SEQ ID NO: 597688 - DNA, 495 bp, Homo sapiens
  misc_feature: HIJSMM301E14QL.49.66.F11.1.454.light.4.raw
agtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagattttgcagtttattactgtcaacagcgtaccacaggattcactttcggccctgggaccagagtggatatcaaacgaaactgtggctgcaccatctgtcttctatcttcccg

SEQ ID NO: 597689 - DNA, 498 bp, Homo sapiens
  misc_feature: HIJSMM301DKQXR.43.34.D01.1.454.light.4.raw
  modified_base (468)..(468): a, c, t, g, unknown or other
tgtgagtagtcacgaccggtgctcgattagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaaagcccccaaactcatgatttatgagggcactaagcggccctcaggggtttctgatcgcttctctggctccaagtctggcaacacggcctccctgacaatctctgggctccaggctgaggacgaggctgattatattgctgctcatatgcaggtagttacacttatgtcttcggaattgggacgacggtnaccgtcctaggtcagcccaaggcaacccca

SEQ ID NO: 597690 - DNA, 457 bp, Homo sapiens; identical to SEQ ID NO: 536586
  misc_feature: HIJSMM301A3IHV.49.85.H08.1.454.light.4.raw

SEQ ID NO: 597691 - DNA, 495 bp, Homo sapiens; identical to SEQ ID NO: 535821
  misc_feature: HIJSMM301DYYZK.3.31.C09.1.454.light.4.raw

SEQ ID NO: 597692 - DNA, 473 bp, Homo sapiens; identical to SEQ ID NO: 535262
  misc_feature: HIJSMM301AYD00.8.67.G01.1.454.light.4.raw

SEQ ID NO: 597693 - DNA, 507 bp, Homo sapiens; identical to SEQ ID NO: 565502
  misc_feature: HIJSMM301CSLUH.8.42.D09.1.454.light.4.raw

SEQ ID NO: 597694 - DNA, 485 bp, Homo sapiens; identical to SEQ ID NO: 550533
  misc_feature: HIJSMM301ASGSS.3.88.H11.1.454.light.4.raw

SEQ ID NO: 597695 - DNA, 498 bp, Homo sapiens
  misc_feature: HIJSMM301BNUIG.2.76.G10.1.454.light.4.raw
acgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgacccccaaactcctcatctctcacaataatcagcggccctcaggagtccctgaccgattctctgcctccaagtccggcacctcagcctccctggccatcagtgggctccgggccgaggatgaggctgattattactgtgcaggatgggatgacaacctgggtgcttatctcttcggacctggaccaaggtcaccgtctt

SEQ ID NO: 597696 - DNA, 475 bp, Homo sapiens; identical to SEQ ID NO: 556952
  misc_feature: HIJSMM301DPNXK.12.49.E05.1.454.light.4.raw

SEQ ID NO: 597697 - DNA, 506 bp, Homo sapiens
  misc_feature: HIJSMM301BQJ7R.41.35.D02.1.454.light.4.raw
tctatactatcacgaccggtgctcgatttagcacacgatagttgggtttgggggggtcacaagaggcagcgctctcgggacgtctccaccatggcctgggctctgctgctcctcactctcctcactcaggacacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctccggggtctctagtcgcttctctggctccaagtttggcaacacggcctccctgaccgtctctgggctccagagtgaagatgaggctgattactactgcgcctcatatgcaggcagcaacaatttcagggtatttggcggagggaccaagctgaccgtcctgggtcagcccaaggctgccccctcggt

SEQ ID NO: 597698 - DNA, 518 bp, Homo sapiens
  misc_feature: HIJSMM301C9X23.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggccaccccagacaggatcagtggcagcgggtctgggacagacttcattctcaccatcaacagactgcagcctgaagatattgcagtttactactgtcagcagtatgttacgtccccgtggacgttcggccaagggaccaaggtgcaatcaaccgaactgtggctgcaccatctgtcttcatcttccccg

SEQ ID NO: 597699 - DNA, 503 bp, Homo sapiens; identical to SEQ ID NO: 551912
  misc_feature: HIJSMM301BGPM6.12.50.E06.1.454.light.4.raw

SEQ ID NO: 597700 - DNA, 520 bp, Homo sapiens
  misc_feature: HIJSMM301ELGS6.27.23.C01.1.454.light.4.raw
agcgtcgtctcacgaccggtgctcgatttagtacacgtgattagggagttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctcctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccacct

SEQ ID NO: 597701 - DNA, 505 bp, Homo sapiens; identical to SEQ ID NO: 535503
  misc_feature: HIJSMM301EVIZ3.8.28.C06.1.454.light.4.raw

SEQ ID NO: 597702 - DNA, 507 bp, Homo sapiens
  misc_feature: HIJSMM301E02DO.3.37.D04.1.454.light.4.raw
agacgcactccacgaccggtgctcgatttagtagcatactgttgggtttgggggggtctcaggaggcagcgctctcgggacgtctccaccatgtcctgggctctgctattcctcaccctcctcactcagggcacagggtcctgggcccagtctgccctgagtcagcctgcctccgtgtctgggtctcctggacagtcgatcaccatctcctgcactggaaccagcagtgacgttggtagatataattatgtctcctggtaccaacaactcccaggcaaagcccccaaactgatgatttatgatgtcaataatcggccctcaggggtttctaatcgcttctctggctccaagtctggcaacacggcctccctgaccatctctgggctccagggtgaggacgaggctgattattactgcagctcatttacaagcagcaccactcaggtcttcggaactgggactaaggtcaccgtctaggtcacgcccaaggccaacccactgtcactc

SEQ ID NO: 597703 - DNA, 503 bp, Homo sapiens
  misc_feature: HIJSMM301ATIIP.48.31.C09.1.454.light.4.raw
agtatacatacacgaccggtgctcgatttagacgtctcatcaaggaaggaaggggcagtctcagtcaggacacagcatggacatgagggtccccgctcagctcctggggctcctgctactctggctccgaggtgccagatgtgacatccagctgacccagtctccatcctccctgtctgcttctgtgggagacagagtcaccatcacttgccgggcaagtcagaacattggcgattacttcaattggtatcagcagaaaccagggaaagcccctaaactcttaatctacactgcagcccggttgcaaagtggagtcccatcaaggttcagtggcaatggatccgggacagattttcggctcaccatcagcagtctacaacctgaagattttgcaacctacttctgtcaccaggcttacaacttcccctccgacgttcggccaagggaccaaggtggaaggtcagacgaactagtggctgcaccatctgtcttcatcttccccg

SEQ ID NO: 597704 - DNA, 498 bp, Homo sapiens; identical to SEQ ID NO: 535295
  misc_feature: HIJSMM301ECWRC.15.25.C03.1.454.light.4.raw

SEQ ID NO: 597705 - DNA, 498 bp, Homo sapiens
  misc_feature: HIJSMM301CLSMH.4.19.B08.1.454.light.4.raw
agcactgtagcacgaccggtgctcgatttagtgagtcagtaaggggggagtcagactcagtcaggacacagcatggacatgagggtccccgctcagctcctggggctcctgctactctggctcccaggagccgattgtggacagtccaggttgacccagtctccctccaccctgtctgcatctataggagacagagtcaccatcacttgtcgggccagtcagaatatcaataggtggttggcctggtatctgcagagaccagggagagccccaaaactccttatctatgatgcctctactttgcacactggggtcccaccaacgttcagcggcagtggatccgggacagaattcactctcaccatcagcagcctgcagcctgatgatcttggaacttattactgccaacagtattaatagtttattaggacgtttcgggccgaggggaacccaaggtgggaaattcaaacgaactgtggctgcaccatctgtcttcta

SEQ ID NO: 597706 - DNA, 524 bp, Homo sapiens
  misc_feature: HIJSMM301DO80Q.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccgaacggaccgaacggtaggaaggtacgaaacgaaacgtacgtggcgtggcaccaactctgtcttctactcttcccgcccact

SEQ ID NO: 597707 - DNA, 486 bp, Homo sapiens
  misc_feature: HIJSMM301ENCNA.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttaggccaggggaccaagctggagatcaaacgaactgtggctgcaccat

SEQ ID NO: 597708 - DNA, 477 bp, Homo sapiens
  misc_feature: HIJSMM301DTXWA.12.1.A01.1.454.light.4.raw
  modified_base (408)..(408): a, c, t, g, unknown or other
  modified_base (464)..(464): a, c, t, g, unknown or other
atacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtgggtcccatcaaggttcagtggcagtgggtctgggacagatttcactctcaccatcagcagtctgcaacctgaagattctgcaacttattactgtcaacagagtaacngttaaccctcccactttcggcggagggaccaaggtggagatcaaacgaactgtggntgcaccatctgtt

SEQ ID NO: 597709 - DNA, 486 bp, Homo sapiens; identical to SEQ ID NO: 535043
  misc_feature: HIJSMM301DYW2G.46.35.D02.1.454.light.4.raw

SEQ ID NO: 597710 - DNA, 514 bp, Homo sapiens; identical to SEQ ID NO: 546238
  misc_feature: HIJSMM301ARCDI.47.85.H08.1.454.light.4.raw

SEQ ID NO: 597711 - DNA, 489 bp, Homo sapiens; identical to SEQ ID NO: 558406
  misc_feature: HIJSMM301BT9U7.19.15.B04.1.454.light.4.raw

SEQ ID NO: 597712 - DNA, 441 bp, Homo sapiens; identical to SEQ ID NO: 534971
  misc_feature: HIJSMM301BFYE0.11.3.A03.1.454.light.4.raw

SEQ ID NO: 597713 - DNA, 509 bp, Homo sapiens
  misc_feature: HIJSMM301CGYYS.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgttcaacagttttctcgggcgttcggccaagggaccgaaggtaggaaatcaaacgaactagtggctggcaccatcctgtctttcatcttccccg

SEQ ID NO: 597714 - DNA, 482 bp, Homo sapiens
  misc_feature: HIJSMM301C9MFY.43.15.B04.1.454.light.4.raw
tgtgagtagtcacgaccggtgctcgatttagacagtatatatccgcggggggagtcagacccagtcaggacacagcatggacatgagggtccccgctcagctcctggggctcctgctgctctggttcccaggttccagatgcgacatccagctgacccagtctccatcttctgtgtctgcatctgtgggagacacagtcaccatcacttgtcgggcgagtcaagttattagtaactggttagcctggtatcagcagaaaccaggaaaagcccctaaactcctgatctatgctgcatccaggttgcagagtggggtcccatcaagattcagcggcagtggatctgggacagatttcactctcactatcagcagcctgcagcctgaagattttgccacttactattgtcaacaggctgacagtttccccttcaccttcggccaagggacacgactggacattaaacgaactgtggctgcaccta

SEQ ID NO: 597715 - DNA, 494 bp, Homo sapiens; identical to SEQ ID NO: 534994
  misc_feature: HIJSMM301CTDH8.27.78.H01.1.454.light.4.raw

SEQ ID NO: 597716 - DNA, 486 bp, Homo sapiens; identical to SEQ ID NO: 535043
  misc_feature: HIJSMM301DPSTG.46.35.D02.1.454.light.4.raw

SEQ ID NO: 597717 - DNA, 497 bp, Homo sapiens
  misc_feature: HIJSMM301DY6OW.10.43.D10.1.454.light.4.raw
catagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccggggccacttcggccctgggaccaaagtggatatcaacgaactagtggctgcaccatctgtcttc

SEQ ID NO: 597718 - DNA, 520 bp, Homo sapiens; identical to SEQ ID NO: 539176
  misc_feature: HIJSMM301D35G1.27.23.C01.1.454.light.4.raw

SEQ ID NO: 597719 - DNA, 444 bp, Homo sapiens
  misc_feature: HIJSMM301DRS60.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccctcctccattcta

SEQ ID NO: 597720 - DNA, 499 bp, Homo sapiens; identical to SEQ ID NO: 537739
  misc_feature: HIJSMM301D3R3V.12.86.H09.1.454.light.4.raw

SEQ ID NO: 597721 - DNA, 444 bp, Homo sapiens; identical to SEQ ID NO: 535192
  misc_feature: HIJSMM301D6QYE.5.9.A09.1.454.light.4.raw

SEQ ID NO: 597722 - DNA, 493 bp, Homo sapiens; identical to SEQ ID NO: 537422
  misc_feature: HIJSMM301AHHUU.9.34.D01.1.454.light.4.raw

SEQ ID NO: 597723 - DNA, 488 bp, Homo sapiens
  misc_feature: HIJSMM301BPQF1.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttgccagggaccaaactggacatacaaacgaaactgtggctgcaccatctgtt

SEQ ID NO: 597724 - DNA, 492 bp, Homo sapiens; identical to SEQ ID NO: 557028
  misc_feature: HIJSMM301BADIS.51.6.A06.1.454.light.4.raw

SEQ ID NO: 597725 - DNA, 498 bp, Homo sapiens
  misc_feature: HIJSMM301B345F.22.57.F02.1.454.light.4.raw
acatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaacagcctgcagcctgatgatttggcaacttactactgccaaccgtatagtacttattcggtcaccttcggccaagggacacgactggagattaaacgaactgtggctgcaccatctgtcttcattccc

SEQ ID NO: 597726 - DNA, 505 bp, Homo sapiens
  misc_feature: HIJSMM301B671Y.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtaactctgttcccaccctcctcg

SEQ ID NO: 597727 - DNA, 521 bp, Homo sapiens; identical to SEQ ID NO: 539470
  misc_feature: HIJSMM301BIQ6G.27.23.C01.1.454.light.4.raw

SEQ ID NO: 597728 - DNA, 495 bp, Homo sapiens
  misc_feature: HIJSMM301DFQCV.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgaggggtgattattactgcagctcatatagaagtggcagcactctcgtattcggcggtgggaccaagctgaccgtcctaggtcagcccaagg

SEQ ID NO: 597729 - DNA, 444 bp, Homo sapiens; identical to SEQ ID NO: 534993
  misc_feature: HIJSMM301CMEUQ.5.9.A09.1.454.light.4.raw

SEQ ID NO: 597730 - DNA, 516 bp, Homo sapiens
  misc_feature: HIJSMM301A9O19.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctcgccccctcggtcactctgttcccccg

SEQ ID NO: 597731 - DNA, 499 bp, Homo sapiens
  misc_feature: HIJSMM301D0AHX.14.3.A03.1.454.light.4.raw
cgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaagcccccaaactcattatttatgaggtcaataatcggccctcaggagtttctaatcgcttctctggctccaagtctggcaacacggcctcctgagcatctctgggctccaggctgaggacgaggctgattattactgcagctcatatactattagcagaactgtggttttcggcggagggaccaaggtgacgtcctaggtcagcccaaggctgccccctcggtcact

SEQ ID NO: 597732 - DNA, 475 bp, Homo sapiens
  misc_feature: HIJSMM301D0XQM.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcgccctgggactgaagtgcatatgaagagaactgtggctgca

SEQ ID NO: 597733 - DNA, 503 bp, Homo sapiens
  misc_feature: HIJSMM301B6JPZ.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgacccgtcctaggtcagcccaa

SEQ ID NO: 597734 - DNA, 467 bp, Homo sapiens
  misc_feature: HIJSMM301BIK8M.12.39.D06.1.454.light.4.raw
atacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggaggggaatggggtgagaaagatccagtgtagagattgtgatgacccagactccagtctccttgtctctcacccctggagagcaggcctccatgtcctgcaggtctagtctgcgcctcctgcatagtgacggatgctcccttttgtattggtttctgcagagaggcaggccagtctccacaactcctgatctatgaagttgccacccggctctctggagtgccagatatgttcagtggctgcgggtcaggcacagatctcacactagaaaaacagaccgggtggagagtgaccatgttggaacttatta

SEQ ID NO: 597735 - DNA, 492 bp, Homo sapiens
  misc_feature: HIJSMM301BSGE8.5.40.D07.1.454.light.4.raw
atcagacacgcacgaccggtgctcgatttagtgatagagcgtaacaacagaggggggaactgctcagttaggacccagacggaaccatggaagccccagcgcagcttctcttcctcctgctactctggctcccagataccattggagagatagtgatgacgcagtctccagccaccctgtctgtgtctccaaggggaaagagccaccctctcctgcagggccagccagagtgtaagtagtaggttagcctggtatcagcagaaacctggccaggctcccaggctcctcatctatggtgcatctaccagggccactggtatcccagccaggttcagtggcagtgggtctgggacagagttcactctcaccatcagcagcctgcagtctgaagattttgctagtttattactgtcaacagtataatgactggtggacgttcggccgaagggaccgaaggtggagaccaaacgaactgtggctgcaccatctgtt

SEQ ID NO: 597736 - DNA, 508 bp, Homo sapiens; identical to SEQ ID NO: 578624
  misc_feature: HIJSMM301EG8BE.47.23.C01.1.454.light.4.raw

SEQ ID NO: 597737 - DNA, 487 bp, Homo sapiens; identical to SEQ ID NO: 536206
  misc_feature: HIJSMM301B9LO8.47.38.D05.1.454.light.4.raw

SEQ ID NO: 597738 - DNA, 494 bp, Homo sapiens
  misc_feature: HIJSMM301BLMVL.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgcagtttattactgtcagcagtatgatacctggcctccgtacacttttggccgggggaccaagctggaaatcaagcgaactgtggctgcaccatctgtctttcatt

SEQ ID NO: 597739 - DNA, 518 bp, Homo sapiens
  misc_feature: HIJSMM301C2ZEJ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgtcgtcgacggaccgacggtacggaagtacgaaacgaaactaacgtaggtcgtgcgaccactactgtcttctactctttccccg

SEQ ID NO: 597740 - DNA, 511 bp, Homo sapiens
  misc_feature: HIJSMM301CTRG4.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaattttgtgtcctggtaccagcagctcccaggaacagcccccaaactcctcatttttgacaataataagcgaccctcagggattcctgaccgattctctggctccaagtctggcacgtcagccaccctgggcatcaccggactccagactggggacgaggccgattattactgcggaacatgggatagcagcctgagtactgtgataatcggcggagggaccaagctgaccgtcctaggtcagcccaaggctgccccctcggtcactctcgttcccg

SEQ ID NO: 597741 - DNA, 493 bp, Homo sapiens
  misc_feature: HIJSMM301CQI8K.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcgggcatccgcagcctgcagcctgaagattttgcgacatattactgtcaacagtatgaaaatgtcccgctcactttcggcgggggaccaaggtggagttcaaacgaactgtggctgcacatctgtcttcat

SEQ ID NO: 597742 - DNA, 484 bp, Homo sapiens; identical to SEQ ID NO: 536162
  misc_feature: HIJSMM301C3QR4.13.59.F04.1.454.light.4.raw

SEQ ID NO: 597743 - DNA, 488 bp, Homo sapiens; identical to SEQ ID NO: 541868
  misc_feature: HIJSMM301A6YM9.14.55.E11.1.454.light.4.raw

SEQ ID NO: 597744 - DNA, 524 bp, Homo sapiens
  misc_feature: HIJSMM301CNG6I.27.23.C01.1.454.light.4.raw
agcgtcgtctcacgaccggtgctcgatttagtacacgtgattagggagttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccgcctccc

SEQ ID NO: 597745 - DNA, 483 bp, Homo sapiens
  misc_feature: HIJSMM301EHRFV.4.34.D01.1.454.light.4.raw
agcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggctcctcatctatggtgcatccaccagggccactggtatcccagccaggttcagtgccagtgggtctgggacagagttcactctcaccatcagcagcctgcagtctgaagattttgcggtttattactgtcagcagtatgataactggctgtacacttttggccgaggggaccaagctggagatcaggcgaactgtggctgca

SEQ ID NO: 597746 - DNA, 520 bp, Homo sapiens; identical to SEQ ID NO: 571628
  misc_feature: HIJSMM301AQEKD.27.23.C01.1.454.light.4.raw

SEQ ID NO: 597747 - DNA, 493 bp, Homo sapiens
  misc_feature: HIJSMM301AIF0Q.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgtagtctattactgtcagcagtatggtcacgtcccaagaacttttggccaggggaccaagactggagatacaaacgaactgtggctgcaccatctgtt

SEQ ID NO: 597748 - DNA, 495 bp, Homo sapiens; identical to SEQ ID NO: 562273
  misc_feature: HIJSMM301CW2FF.10.17.B06.1.454.light.4.raw

SEQ ID NO: 597749 - DNA, 517 bp, Homo sapiens
  misc_feature: HIJSMM301C5FVY.27.78.H01.1.454.light.4.raw
  modified_base (407)..(407): a, c, t, g, unknown or other
  modified_base (470)..(470): a, c, t, g, unknown or other
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctggggacacattttcaccctcaccatcaagtancctggaagctgaagatactgcaacttattactgtcatcagagtacttacttaccttcagtagntacaccttcggtccgacggacgaacgactaggagagtaaactaaacg

SEQ ID NO: 597750 - DNA, 494 bp, Homo sapiens; identical to SEQ ID NO: 549057
  misc_feature: HIJSMM301AT2H2.10.33.C11.1.454.light.4.raw

SEQ ID NO: 597751 - DNA, 484 bp, Homo sapiens
  misc_feature: HIJSMM301CT6YD.26.70.G04.1.454.light.4.raw
agactatactcacgaccggtgctcgatttagtgtagtgtgaagggaaagggggcaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgtcgggcgagtcagggcattagcgtattttttagcctggtttcagcagaaaccagggaaagcccccaagtccctgatctatgctgcgtccactttagaaggtggagtcccatcaaggttcagcggcagtggatctgggacagagttcactctcaacatcagcagcctgcagcctgaggattttgcaacttattactgccagcagtataatgattaccctatcaccttcggccggggacacggctggaaactaaacgaactgtgctgcacc

SEQ ID NO: 597752 - DNA, 499 bp, Homo sapiens
  misc_feature: HIJSMM301DV372.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggtccgaagggacgacgactggagattaaaggaactagtggctgcaccactctgtcttcatcttccccg

SEQ ID NO: 597753 - DNA, 481 bp, Homo sapiens; identical to SEQ ID NO: 545581
  misc_feature: HIJSMM301DDR0X.48.19.B08.1.454.light.4.raw

SEQ ID NO: 597754 - DNA, 494 bp, Homo sapiens; identical to SEQ ID NO: 535276
  misc_feature: HIJSMM301ESXMN.16.6.A06.1.454.light.4.raw

SEQ ID NO: 597755 - DNA, 502 bp, Homo sapiens; identical to SEQ ID NO: 594138
  misc_feature: HIJSMM301BHJFI.40.33.C11.1.454.light.4.raw

SEQ ID NO: 597756 - DNA, 493 bp, Homo sapiens; identical to SEQ ID NO: 538916
  misc_feature: HIJSMM301EMPK5.27.78.H01.1.454.light.4.raw

SEQ ID NO: 597757 - DNA, 453 bp, Homo sapiens
  misc_feature: HIJSMM301DG7PX.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgcccctcggtcactctgttcccaccctcctacacgagagta

SEQ ID NO: 597758 - DNA, 496 bp, Homo sapiens; identical to SEQ ID NO: 535109
  misc_feature: HIJSMM301DA6CN.16.78.H01.1.454.light.4.raw

SEQ ID NO: 597759 - DNA, 518 bp, Homo sapiens; identical to SEQ ID NO: 543797
  misc_feature: HIJSMM301A153X.19.80.H03.1.454.light.4.raw

SEQ ID NO: 597760 - DNA, 503 bp, Homo sapiens; identical to SEQ ID NO: 553138
  misc_feature: HIJSMM301CGKBT.22.15.B04.1.454.light.4.raw

SEQ ID NO: 597761 - DNA, 495 bp, Homo sapiens; identical to SEQ ID NO: 536055
  misc_feature: HIJSMM301B0NCB.47.38.D05.1.454.light.4.raw

SEQ ID NO: 597762 - DNA, 481 bp, Homo sapiens; identical to SEQ ID NO: 535993
  misc_feature: HIJSMM301AXBEP.21.25.C03.1.454.light.4.raw

SEQ ID NO: 597763 - DNA, 495 bp, Homo sapiens; identical to SEQ ID NO: 537415
  misc_feature: HIJSMM301AUJOK.4.27.C05.1.454.light.4.raw

SEQ ID NO: 597764 - DNA, 477 bp, Homo sapiens; identical to SEQ ID NO: 537453
  misc_feature: HIJSMM301ASQR6.8.85.H08.1.454.light.4.raw

SEQ ID NO: 597765 - DNA, 486 bp, Homo sapiens; identical to SEQ ID NO: 537617
  misc_feature: HIJSMM301DJZAE.10.53.E09.1.454.light.4.raw

SEQ ID NO: 597766 - DNA, 497 bp, Homo sapiens; identical to SEQ ID NO: 590966
  misc_feature: HIJSMM301CLP8T.4.59.F04.1.454.light.4.raw

SEQ ID NO: 597767 - DNA, 484 bp, Homo sapiens; identical to SEQ ID NO: 553925
  misc_feature: HIJSMM301EBEY8.43.24.C02.1.454.light.4.raw

SEQ ID NO: 597768 - DNA, 502 bp, Homo sapiens
  misc_feature: HIJSMM301EMKV1.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacactttatgtcttcggaattgggacacggtcaccgtcctaggtcaggcccaaggccaaccccta

SEQ ID NO: 597769 - DNA, 517 bp, Homo sapiens
  misc_feature: HIJSMM301BK7E3.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggtcgttcgccgaagggaccgaaggtaggaaagtacaaaacgaacctagtaggctgcaccaactctgttcttctactccttccccg

SEQ ID NO: 597770 - DNA, 498 bp, Homo sapiens
  misc_feature: HIJSMM301B229O.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctccggtccactctgttcccaccctcctcgagtgcgtct

SEQ ID NO: 597771 - DNA, 509 bp, Homo sapiens; identical to SEQ ID NO: 540142
  misc_feature: HIJSMM301BRH13.8.38.D05.1.454.light.4.raw

SEQ ID NO: 597772 - DNA, 486 bp, Homo sapiens; identical to SEQ ID NO: 535290
  misc_feature: HIJSMM301A732R.3.12.B01.1.454.light.4.raw

SEQ ID NO: 597773 - DNA, 439 bp, Homo sapiens
  misc_feature: HIJSMM301C1LEQ.41.9.A09.1.454.light.4.raw
tctatactatcacgaccggtgctcgatttagcgagacgcgcagggtcctgggcccagtctgtcctgactcagccaccctcagcgtctgggacccccgggcagacggtgaccatctcctgttctggaagcagttccaacatcggaagtaataatgtgaattggtaccgacaactcccaggaacggccccaaactcctcatacatagtaatgatcatcggcccctggggtccctgaccgaatctctggctccaggtctggcgcctcagcctccctggtcattagtgggctccagtctgacgatgaggctgactattactgttcagcgtgggatgccagcccgaatcattgggtgttcggcggagggaccaaactgaccgtcctaggtcagcccaaggctgccccctcggtcactctgttcccaccctcctcatagtataga

SEQ ID NO: 597774 - DNA, 495 bp, Homo sapiens
  misc_feature: HIJSMM301EE8LD.7.31.C09.1.454.light.4.raw
cgtgtctctacacgaccggtgctcgatttagacgtctcatcaaggaaggaaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcaggggtttccaatcgcttctctggctccaagtctggcgacacggcctccctgaccatctctgggctccaggctgaagacgaggctgattattactgcagctcatatacaggcagcagcactcaggttttcggcggagggaccaagctgaccgtcctaggtcagcccaaggct

SEQ ID NO: 597775 - DNA, 495 bp, Homo sapiens; identical to SEQ ID NO: 536359
  misc_feature: HIJSMM301D4H40.48.4.A04.1.454.light.4.raw

SEQ ID NO: 597776 - DNA, 495 bp, Homo sapiens; identical to SEQ ID NO: 550605
  misc_feature: HIJSMM301EVBON.41.38.D05.1.454.light.4.raw

SEQ ID NO: 597777 - DNA, 496 bp, Homo sapiens; identical to SEQ ID NO: 536248
  misc_feature: HIJSMM301AIYML.22.27.C05.1.454.light.4.raw

SEQ ID NO: 597778 - DNA, 495 bp, Homo sapiens
  misc_feature: HIJSMM301D2EEC.27.78.H01.1.454.light.4.raw
  modified_base (463)..(463): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcagtgatcaccttcggaccaagggacacgactgganaattaacgaactgtggctgcaccatctgtctt

SEQ ID NO: 597779 - DNA, 517 bp, Homo sapiens
  misc_feature: HIJSMM301CR1RH.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggtgcaccgcaaagcgggacccagaccctggagcctcagttggaagcagccgatccagcctgcggagcctgtggggcaggtcagcccaaggctcgccccctcgtcactctcgtcccgccctcctccaccg

SEQ ID NO: 597780 - DNA, 378 bp, Homo sapiens; identical to SEQ ID NO: 577487
  misc_feature: HIJSMM301AX05V.49.42.D09.1.454.light.4.raw

SEQ ID NO: 597781 - DNA, 505 bp, Homo sapiens; identical to SEQ ID NO: 535987
  misc_feature: HIJSMM301CQIFX.18.37.D04.1.454.light.4.raw

SEQ ID NO: 597782 - DNA, 492 bp, Homo sapiens
  misc_feature: HIJSMM301BURWD.51.71.G05.1.454.light.4.raw
cgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatatcttcggaactgcgaccaaggtcaccgtcctgggtcaggcccaaggccaaccccacgt

SEQ ID NO: 597783 - DNA, 484 bp, Homo sapiens; identical to SEQ ID NO: 535211
  misc_feature: HIJSMM301AT8C1.47.46.E02.1.454.light.4.raw

SEQ ID NO: 597784 - DNA, 480 bp, Homo sapiens
  misc_feature: HIJSMM301EQBMV.41.12.B01.1.454.light.4.raw
tctatactatcacgaccggtgctcgatttagtagtgtagattccgcgggcacgaccggtgctcgatttagtacagatcgttagggaaaggggctgggcctcaggaagcagcatcggaggtgcctcagccatggcatggatccctctcttcctcggcgtccttgcttactgcacaggatctgtggcctcctttgagctgactcagccaccctcagtgtccgtgtccccaggacagacagccagcatcacctgctctggagataaattggggaataaatatgcttcctggtatcagcagaagccaggccagtcccctgtgctggtcatctatcaaagttcccagcggccctcagggatccctgagcgattctctggctccaattctgggaacacagccactctgaccatcagcgggacccaggctatcgatgaggctgagtattactgtcaggcgtgggacatcagcactgaggtggtattc

SEQ ID NO: 597785 - DNA, 488 bp, Homo sapiens; identical to SEQ ID NO: 535081
  misc_feature: HIJSMM301B1QWN.26.23.C01.1.454.light.4.raw

SEQ ID NO: 597786 - DNA, 493 bp, Homo sapiens
  misc_feature: HIJSMM301BI24N.13.42.D09.1.454.light.4.raw
  modified_base (463)..(463): a, c, t, g, unknown or other
tcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctcggacgtggtcaggacgaacggtaggaagtanaaacgaactagtggcgtgcaccactctgtt

SEQ ID NO: 597787 - DNA, 441 bp, Homo sapiens; identical to SEQ ID NO: 535074
  misc_feature: HIJSMM301DRUW8.11.3.A03.1.454.light.4.raw

SEQ ID NO: 597788 - DNA, 518 bp, Homo sapiens
  misc_feature: HIJSMM301CR1QG.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccaagggaccgaacggtaggaaggtacaaacgaactagtggcgtgcaccactctgtcttctatcttcccgtcccact

SEQ ID NO: 597789 - DNA, 496 bp, Homo sapiens; identical to SEQ ID NO: 538619
  misc_feature: HIJSMM301AMOER.12.37.D04.1.454.light.4.raw

SEQ ID NO: 597790 - DNA, 490 bp, Homo sapiens
  misc_feature: HIJSMM301D9INN.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaactttactactgtcaacagagtttacacgtacccccctcactttcggcggaggaccgaaggcggagatcagacgaatgtgctgcaccatctgtcttcta

SEQ ID NO: 597791 - DNA, 514 bp, Homo sapiens; identical to SEQ ID NO: 540552
  misc_feature: HIJSMM301AEA2I.16.66.F11.1.454.light.4.raw

SEQ ID NO: 597792 - DNA, 524 bp, Homo sapiens
  misc_feature: HIJSMM301DOR49.52.7.A07.1.454.light.4.raw
cgcagtacgacacgaccggtgctcgatttagcacgtgtcgcaggggggggtcacaagaggcagcgctctcgggacgtctccaccatggcctgggctctgctgctcctcaccctcctcactcaggacacagggtcctgggcccagtctgccctggctcaacctgcctccgtgtctgggtctcctggacagtcgatcaccatctcctgcgccggaaccaacaatgatgttgggagttataaacttgtctcctggtatcaacaacaccccggcaaagcccccaaactcatcatttatgaggtcactaagcggccctcgggggtttctaatcgcttctctggctccaagtctggcgacacggcctccctgacaatctcttggctccaggctgaggacgaggctgattatttttgctgctcatatgcgggtagtagtaattatgtctttcggaagtgggaccacggtcaccgtcctgggtcagcccaaggccaacccactgtcactctgttcccgccctcctctatacg

SEQ ID NO: 597793 - DNA, 481 bp, Homo sapiens
  misc_feature: HIJSMM301C5AWQ.48.84.H07.1.454.light.4.raw
agtatacatacacgaccggtgctcgatttagcagacgtctgtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacaatcacctgcactgggaacaacaataatgtcgccaaccaaggagcagcttggctgcagcagcaccagggccaccctcccaaagtcgtatccgacagggataacaatcggcccttagggatctcagagagaatatctgcatccaggtcaggaaacacagcctcctgaccattactggactccaacctgaggacgaggctgactattattgctcagcatggacaccagcctcaatgccgcggtattcggcgcagggaccaagctgaccgtcctaggtcacg

SEQ ID NO: 597794 - DNA, 494 bp, Homo sapiens; identical to SEQ ID NO: 534994
  misc_feature: HIJSMM301BLCMC.27.78.H01.1.454.light.4.raw

SEQ ID NO: 597795 - DNA, 468 bp, Homo sapiens
  misc_feature: HIJSMM301ASJYF.3.20.B09.1.454.light.4.raw
agacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcgtctatttaaattggtatcagcacaaaccagggaaagcccctaagctcctgatctatgctgaatccactttgcaaagtggggtcccatcaaggttcagtggcagtggatctgggacagatttcactctaaccatcagcggtctgcaacctgaagattttgcaactcactactgtcaacagagtgacagcacgcctcacactttcgcggagggaccaaaggtggaggatcaaacggaa

SEQ ID NO: 597796 - DNA, 489 bp, Homo sapiens; identical to SEQ ID NO: 535139
  misc_feature: HIJSMM301B8YMA.14.55.E11.1.454.light.4.raw

SEQ ID NO: 597797 - DNA, 491 bp, Homo sapiens
  misc_feature: HIJSMM301AJWVB.51.35.D02.1.454.light.4.raw
cgatcgtatacacgaccggtgctcgatttagcacacgatagttgggtttggggctggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcc

SEQ ID NO: 597798 - DNA, 494 bp, Homo sapiens
  misc_feature: HIJSMM301CU1QS.27.78.H01.1.454.light.4.raw
agcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaaggacacgactggagattaaacgaactgtggctgcaccatctgtt

SEQ ID NO: 597799 - DNA, 498 bp, Homo sapiens; identical to SEQ ID NO: 544837
  misc_feature: HIJSMM301EULO8.11.71.G05.1.454.light.4.raw

SEQ ID NO: 597800 - DNA, 498 bp, Homo sapiens
  misc_feature: HIJSMM301C3JHM.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccaaggtgaccgtcctaggtcagcccaaggctcgccccctcggtcactctcg

SEQ ID NO: 597801 - DNA, 509 bp, Homo sapiens
  misc_feature: HIJSMM301DT6PH.43.78.H01.1.454.light.4.raw
tgtgagtagtcacgaccggtgctcgatttagtgtgagtagtttgggtttgggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagtattttgcagtgtattactgtcagcagtatggtagctcaccgatcaccttccggccaagggacacgactggagattaaccgaactgtggctgcaccatctgtcttcatcttccccg

SEQ ID NO: 597802 - DNA, 479 bp, Homo sapiens
  misc_feature: HIJSMM301ASIEU.12.1.A01.1.454.light.4.raw
  modified_base (467)..(467): a, c, t, g, unknown or other
atacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgcaacttattactgtcaacagagtaacagttaccctcccacttcggcggaggaccgaaggtggagatcaaacgaactagtcccggntgcaccatctgt

SEQ ID NO: 597803 - DNA, 498 bp, Homo sapiens; identical to SEQ ID NO: 566497
  misc_feature: HIJSMM301BQ0NQ.52.60.F05.1.454.light.4.raw

SEQ ID NO: 597804 - DNA, 496 bp, Homo sapiens
  misc_feature: HIJSMM301DPQFW.19.71.G05.1.454.light.4.raw
tactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaaacatattattatacttcgtggacgttcggccaagggaccgaaggtggatatcagacgaactgtggctgcta

SEQ ID NO: 597805 - DNA, 485 bp, Homo sapiens
  misc_feature: HIJSMM301AN25D.49.55.E11.1.454.light.4.raw
agtcgagagacacgaccggtgctcgatttagcactcgcacgttgggtttgggggctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccagggtggagatcaaacgaac

SEQ ID NO: 597806 - DNA, 466 bp, Homo sapiens; identical to SEQ ID NO: 541765
  misc_feature: HIJSMM301BWYAF.11.70.G04.1.454.light.4.raw

SEQ ID NO: 597807 - DNA, 496 bp, Homo sapiens; identical to SEQ ID NO: 538199
  misc_feature: HIJSMM301BYK0Q.11.81.H04.1.454.light.4.raw

SEQ ID NO: 597808 - DNA, 487 bp, Homo sapiens; identical to SEQ ID NO: 537220
  misc_feature: HIJSMM301BCO44.16.53.E09.1.454.light.4.raw

SEQ ID NO: 597809 - DNA, 488 bp, Homo sapiens
  misc_feature: HIJSMM301ESP5R.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttatttactgcatgcaagttctacaaacttcctacacttttggccaggggaccaagctggagatcaaacgaa

SEQ ID NO: 597810 - DNA, 504 bp, Homo sapiens; identical to SEQ ID NO: 585508
  misc_feature: HIJSMM301DSV11.14.57.F02.1.454.light.4.raw

SEQ ID NO: 597811 - DNA, 508 bp, Homo sapiens
  misc_feature: HIJSMM301C7UM0.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttgggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcta

SEQ ID NO: 597812 - DNA, 486 bp, Homo sapiens; identical to SEQ ID NO: 535043
  misc_feature: HIJSMM301AI6JO.46.35.D02.1.454.light.4.raw

SEQ ID NO: 597813 - DNA, 416 bp, Homo sapiens; identical to SEQ ID NO: 545902
  misc_feature: HIJSMM301DO9DP.18.78.H01.1.454.light.4.raw

SEQ ID NO: 597814 - DNA, 473 bp, Homo sapiens; identical to SEQ ID NO: 538875
  misc_feature: HIJSMM301DVNBP.4.75.G09.1.454.light.4.raw

SEQ ID NO: 597815 - DNA, 492 bp, Homo sapiens
  misc_feature: HIJSMM301DV03K.47.38.D05.1.454.light.4.raw
agctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattacttgcatgcaagttctacaaacttcctacacttttggccaggggaccaagctggagatcaaacgaactagtgg

SEQ ID NO: 597816 - DNA, 453 bp, Homo sapiens; identical to SEQ ID NO: 594220
  misc_feature: HIJSMM301BGC56.19.86.H09.1.454.light.4.raw

SEQ ID NO: 597817 - DNA, 447 bp, Homo sapiens; identical to SEQ ID NO: 535201
  misc_feature: HIJSMM301COYKW.18.9.A09.1.454.light.4.raw

SEQ ID NO: 597818 - DNA, 479 bp, Homo sapiens; identical to SEQ ID NO: 535118
  misc_feature: HIJSMM301EJDRN.13.59.F04.1.454.light.4.raw

SEQ ID NO: 597819 - DNA, 498 bp, Homo sapiens; identical to SEQ ID NO: 548544
  misc_feature: HIJSMM301AYDRK.22.14.B03.1.454.light.4.raw

SEQ ID NO: 597820 - DNA, 499 bp, Homo sapiens
  misc_feature: HIJSMM301C79LC.9.67.G01.1.454.light.4.raw
tgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctctagccaccctgtctgtgtttccaggagaaacagccactctcacctgcagggccagtcagagtcttggcaccaacttagcctggtaccagcagagacctggcttggctcccagggtcctcatctacggtgcgtccagcagggccactggtatcccggccaggttcagtggtagtgggtctgggacagagttcgttctcaccatcagcagcctgcagtctgaagattttgcagtttattactgtcagcactataatagttggccgctcactttcggcggagggaccaaggtggagctcaaacgaactgtggctgcaccatctgtcttcattcc

SEQ ID NO: 597821 - DNA, 486 bp, Homo sapiens
  misc_feature: HIJSMM301DLY6C.40.85.H08.1.454.light.4.raw
tctagcgactcacgaccggtgctcgatttagtatcactcagtcgcgggggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcacttgccgggcaagtcaggacattaaaagtgatttgggctggtatcagcagaaaccagggagagcccctaagctcctcatctatgctgcatccactttacaaagtggagtcccatcaaggttcagcggcagtggatctggcacagatttcactctcaccatcagcagcctgcagcctgaagattttgcaacttattattgtctacacgactacagttaccctcggacgttcggtccaacgggaccgaacggtggaaagtcaaacgaactagtggctgcaccta

SEQ ID NO: 597822 - DNA, 482 bp, Homo sapiens; identical to SEQ ID NO: 535796
  misc_feature: HIJSMM301EBEDT.51.64.F09.1.454.light.4.raw

SEQ ID NO: 597823 - DNA, 510 bp, Homo sapiens
  misc_feature: HIJSMM301ENUKM.9.14.B03.1.454.light.4.raw
tgatacgtctcacgaccggtgctcgatttagtgtgagtagttccgcgggggtgggctcaggaggcagagctctgggaatctcaccatggcctggacccctctcctgctccccctcctcactttctgcacagtctctgaggcctcctatgatctgacacagccaccctcggtgtcagtgtccccaggacagacggccaggatcacctgctctggagatggattatcaaaaaaatatgtttattggtaccaacagaagtcaggccaggccccccttctagtcatctatgaggacgccaggcgaccctccgggatccctgagagaatctcgggctccagttcagggacagtggccaccttgacgatcggtggggcccaggtggaagatgaagctgactacttctgttactcaacagacgacagtgcggatcatagagggatgttcggcggaggaccaagctgaccgtctaggtcagcccaaggctgccccctggtcactctgttcccacctct

SEQ ID NO: 597824 - DNA, 499 bp, Homo sapiens
  misc_feature: HIJSMM301C88OJ.52.36.D03.1.454.light.4.raw
cgcagtacgacacgaccggtgctcgatttagctgcgtcacgatctctcttggggtgtgggctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtactggggaaaattatgctgactggtaccagcagaagccaggccaagcccctgagttggtgatatacgaaaatagtgagcgctaccctgggatccctgaccgattctctgggtccacctcagggaagacgaccaccctgaccatcaacagggtccggactgaagacgaggctgactattactgcttgtctggggatgaggacacattggtgttcgggcggagggaccaagctgaccgtcctacgtcagcccaaggctgccccctcggtcactctcg

SEQ ID NO: 597825 - DNA, 487 bp, Homo sapiens
  misc_feature: HIJSMM301AL3QD.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattcttccagcgttcggccaggggaccaaggtggaagtcaagcgaactgtggctgcaccatct

SEQ ID NO: 597826 - DNA, 470 bp, Homo sapiens
  misc_feature: HIJSMM301AQNXD.51.67.G01.1.454.light.4.raw
cgatcgtatacacgaccggtgctcgatttagagtatacatattgggtttgggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggcggggggaccgaaggtggagatcaagcgaa

SEQ ID NO: 597827 - DNA, 492 bp, Homo sapiens; identical to SEQ ID NO: 549170
  misc_feature: HIJSMM301EKRN5.40.81.H04.1.454.light.4.raw

SEQ ID NO: 597828 - DNA, 503 bp, Homo sapiens; identical to SEQ ID NO: 538884
  misc_feature: HIJSMM301BTBIQ.27.78.H01.1.454.light.4.raw

SEQ ID NO: 597829 - DNA, 490 bp, Homo sapiens
  misc_feature: HIJSMM301E2OLF.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtgaggtcaaacgaaactgtggctgcaccatctgtcttcat

SEQ ID NO: 597830 - DNA, 506 bp, Homo sapiens
  misc_feature: HIJSMM301EU73T.5.86.H09.1.454.light.4.raw
atcagacacgcacgaccggtgctcgatttagtgctatagacttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgacccgtcctaggtcagcccaaggctcgccccctcggtcta

SEQ ID NO: 597831 - DNA, 485 bp, Homo sapiens; identical to SEQ ID NO: 559908
  misc_feature: HIJSMM301B94PD.3.88.H11.1.454.light.4.raw

SEQ ID NO: 597832 - DNA, 494 bp, Homo sapiens; identical to SEQ ID NO: 534994
  misc_feature: HIJSMM301EZ7T7.27.78.H01.1.454.light.4.raw

SEQ ID NO: 597833 - DNA, 487 bp, Homo sapiens; identical to SEQ ID NO: 541889
  misc_feature: HIJSMM301AL9GU.26.23.C01.1.454.light.4.raw

SEQ ID NO: 597834 - DNA, 503 bp, Homo sapiens
  misc_feature: HIJSMM301EP8YV.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaggaccaggtggaagtcaagcgaactgtgctgcaccatctgtcttcatcttccgcc

SEQ ID NO: 597835 - DNA, 508 bp, Homo sapiens; identical to SEQ ID NO: 554667
  misc_feature: HIJSMM301DQRYA.2.21.B10.1.454.light.4.raw

SEQ ID NO: 597836 - DNA, 490 bp, Homo sapiens
  misc_feature: HIJSMM301AJS9R.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcggattcgtctaggcgtccaagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaaggccaa

SEQ ID NO: 597837 - DNA, 472 bp, Homo sapiens
  misc_feature: HIJSMM301CRUBM.15.81.H04.1.454.light.4.raw
tctacgtagccacgaccggtgctcgatttagtagtgtagattcgcgggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgccccctcggtcactctgttcccaccctcctcgctacgtga

SEQ ID NO: 597838 - DNA, 497 bp, Homo sapiens; identical to SEQ ID NO: 542618
  misc_feature: HIJSMM301A1YQW.16.46.E02.1.454.light.4.raw

SEQ ID NO: 597839 - DNA, 494 bp, Homo sapiens; identical to SEQ ID NO: 553467
  misc_feature: HIJSMM301AJ52W.13.67.G01.1.454.light.4.raw

SEQ ID NO: 597840 - DNA, 511 bp, Homo sapiens
  misc_feature: HIJSMM301AWNZ1.9.37.D04.1.454.light.4.raw
tgatacgtctcacgaccggtgctcgatttagtagcatactgttgggtttggggggtgtggtggtgcctcagccatggcctggaccgttctcctcctcggcctcctctctcactgcacaggctctgtgacctcctacgtgctgactcagccaccctcggtgtcagtggccccaggaaagacggccaccattacgtgtgggggatacaacattggaagtaaaagtgttcactggtaccagcagaagccaggccaggcccctgtgttggtcgtctatgatgatacagaccggccctcagggatccctgagcgattctctggctccaattctggtgacacggccaccctgatcatcagcagggtcgaggtcgaggatgaggccgactattactgtcaggtgtgggatagtggtactgatcattgggtgttcggcggagggaccaagctgaccgtcctaggtcagcccaaggctgccccctcggtcactctgttcccaccctcctcagacgtatca

SEQ ID NO: 597841 - DNA, 486 bp, Homo sapiens; identical to SEQ ID NO: 539938
  misc_feature: HIJSMM301BWLED.15.1.A01.1.454.light.4.raw

SEQ ID NO: 597842 - DNA, 503 bp, Homo sapiens
  misc_feature: HIJSMM301ER6IP.41.35.D02.1.454.light.4.raw
tctatactatcacgaccggtgctcgatttagcacacgatagttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctgatcgcttctctggctccaagtctggcaatacggctccctgacagtctctcggctccaggcggaggacgaggctgattactactgcttctcatatgcagatactaagtcctgggtgttcggcggagggaccaagctgaccgtcctaggtcagcccaaggctgccccctcggt

SEQ ID NO: 597843 - DNA, 498 bp, Homo sapiens
  misc_feature: HIJSMM301AEQAL.5.12.B01.1.454.light.4.raw
atcagacacgcacgaccggtgctcgatttagtagtgtagattccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaacagtgacattggtgcttatgactatgtctcgtggtatcaaaagtatccagacacagcccccaaactcatcctttatgatgtccgtgttcggccctcaggggtttctgttcgcttctctggctccaagtctggcagcacggcctccctgaccatctctgggctccaggctgaggacgaggctgactattattgcagttcatatggtagtatgaagactcttgtgtattttcgggcggagggaccaagctgaccgtcctgagtcagcccaaggctccg

SEQ ID NO: 597844 - DNA, 505 bp, Homo sapiens; identical to SEQ ID NO: 536254
  misc_feature: HIJSMM301BZVZI.7.71.G05.1.454.light.4.raw

SEQ ID NO: 597845 - DNA, 511 bp, Homo sapiens
  misc_feature: HIJSMM301CY6F3.41.28.C06.1.454.light.4.raw
tctatactatcacgaccggtgctcgatttagagctcacgtattgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaaccccactgtcact

SEQ ID NO: 597846 - DNA, 489 bp, Homo sapiens
  misc_feature: HIJSMM301D1UPK.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgctaacttattactgccaacagtataatggttatgaatccacttttggccaagggaccaagctggagatcaaacgaactgtggctgcacc

SEQ ID NO: 597847 - DNA, 507 bp, Homo sapiens; identical to SEQ ID NO: 561702
  misc_feature: HIJSMM301ECG10.5.24.C02.1.454.light.4.raw

SEQ ID NO: 597848 - DNA, 495 bp, Homo sapiens
  misc_feature: HIJSMM301EPXNT.51.6.A06.1.454.light.4.raw
cgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtggtacttatgtcttcggaactgggaccaaggtcaccgtcctaggtcagcccaaggcccaacccactgtcactcttccg

SEQ ID NO: 597849 - DNA, 488 bp, Homo sapiens; identical to SEQ ID NO: 551155
  misc_feature: HIJSMM301AV4Z1.3.33.C11.1.454.light.4.raw

SEQ ID NO: 597850 - DNA, 501 bp, Homo sapiens; identical to SEQ ID NO: 553272
  misc_feature: HIJSMM301CJZIW.43.34.D01.1.454.light.4.raw

SEQ ID NO: 597851 - DNA, 522 bp, Homo sapiens; identical to SEQ ID NO: 591032
  misc_feature: HIJSMM301B9DOE.27.23.C01.1.454.light.4.raw

SEQ ID NO: 597852 - DNA, 448 bp, Homo sapiens; identical to SEQ ID NO: 538166
  misc_feature: HIJSMM301CMN0E.18.9.A09.1.454.light.4.raw

SEQ ID NO: 597853 - DNA, 477 bp, Homo sapiens
  misc_feature: HIJSMM301CN5H2.17.26.C04.1.454.light.4.raw
cgtagactagcacgaccggtgctcgatttagtctagcgactttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcatgtcagagcattagcagctatttaaattggtatcagcagaaaccagggaaagcccctaagctcctgatctatgctgcatccagtttgcaaagtggggtcccattaaggttcagtggcagtggatctgggacagatttcactctcaccatcagcagtctgcaacctgaagattttgcaacttactcctgtcaacagagttacagtaccccgttcacttttggccaggggaccaagctggagatcaaacgaactgtggctgcacc

SEQ ID NO: 597854 - DNA, 501 bp, Homo sapiens
  misc_feature: HIJSMM301ED21H.48.25.C03.1.454.light.4.raw
agtatacatacacgaccggtgctcgatttagtagtgtagatttgggtttggggggggtcacaagaggcagcgctctcgggacgtctccaccatggcctgggctctgctgctgttcatcctcctcactcaggacacagggtcctggacccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgattattattgctgctcatatgcaggtggtactacttgggtgttcggcagagggaccaagctgaccgtcctaggtcagcccaaggctgccccctc

SEQ ID NO: 597855 - DNA, 518 bp, Homo sapiens; identical to SEQ ID NO: 539372
  misc_feature: HIJSMM301CYSJ2.7.86.H09.1.454.light.4.raw

SEQ ID NO: 597856 - DNA, 499 bp, Homo sapiens
  misc_feature: HIJSMM301CE4SO.17.29.C07.1.454.light.4.raw
cgtagactagcacgaccggtgctcgatttagagtgctacgaagggaaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtcctaggtcagcccaaggctgcccccc

SEQ ID NO: 597857 - DNA, 498 bp, Homo sapiens
  misc_feature: HIJSMM301AIU1T.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagttttattattgtcagcaatattatattcctcctcagacgttcggaccaagggaccaaggtggaaatcaaacgaactgtggctgcacc

SEQ ID NO: 597858 - DNA, 487 bp, Homo sapiens; identical to SEQ ID NO: 546036
  misc_feature: HIJSMM301DTL0F.8.12.B01.1.454.light.4.raw

SEQ ID NO: 597859 - DNA, 485 bp, Homo sapiens; identical to SEQ ID NO: 535606
  misc_feature: HIJSMM301D3X3E.47.46.E02.1.454.light.4.raw

SEQ ID NO: 597860 - DNA, 504 bp, Homo sapiens; identical to SEQ ID NO: 538940
  misc_feature: HIJSMM301AR404.2.35.D02.1.454.light.4.raw

SEQ ID NO: 597861 - DNA, 454 bp, Homo sapiens; identical to SEQ ID NO: 536449
  misc_feature: HIJSMM301DHZQV.18.78.H01.1.454.light.4.raw

SEQ ID NO: 597862 - DNA, 490 bp, Homo sapiens; identical to SEQ ID NO: 564512
  misc_feature: HIJSMM301EZUB0.11.28.C06.1.454.light.4.raw

SEQ ID NO: 597863 - DNA, 485 bp, Homo sapiens
  misc_feature: HIJSMM301BHY9L.47.60.F05.1.454.light.4.raw
agctcacgtacacgaccggtgctcgatttagtacgtcatcagggaaagggggaggaacgtgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaagggacacgactggagattaaacgaactgtggctgcaccat

SEQ ID NO: 597864 - DNA, 500 bp, Homo sapiens
  misc_feature: HIJSMM301D2YOK.52.55.E11.1.454.light.4.raw
cgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgtctccaggggggagagccaccctctcctgcagggccagtcagagtgttggcaacctcttagcctggtaccaacaaaaacctggccaggctcccaggctcctcatctatgatgcatccacgagggccactggcatcccagccaggttcagtggcagtgggtctgagacagacttcactctcaccatcagtggcctcgagcctgaagattttgcagtttattactgtcagcagcgtagccactggctctctttcggcggagggaccaaggttgagatcaaacgaactgtggctgcaccatctgtcttcatcttcccg

SEQ ID NO: 597865 - DNA, 461 bp, Homo sapiens; identical to SEQ ID NO: 593336
  misc_feature: HIJSMM301C1IDQ.49.8.A08.1.454.light.4.raw

SEQ ID NO: 597866 - DNA, 478 bp, Homo sapiens
  misc_feature: HIJSMM301DMWXX.16.86.H09.1.454.light.4.raw
tgtactactccacgaccggtgctcgatttagtgctatagacttgggtttgggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgccccctcggtcactctgttcccgccctcctcggagtagtaca

SEQ ID NO: 597867 - DNA, 511 bp, Homo sapiens
  misc_feature: HIJSMM301DYHG7.5.58.F03.1.454.light.4.raw
atcagacacgcacgaccggtgctcgatttagtctgatcgagaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtccagcccaaggccaacccactgtcactctcg

SEQ ID NO: 597868 - DNA, 481 bp, Homo sapiens
  misc_feature: HIJSMM301BNU15.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagatttgcaacttactactgtcaacagagttacggtacccgtacacttttgccagggaccaaactggacatcaacgaactgtgctgcaccatctgt

SEQ ID NO: 597869 - DNA, 491 bp, Homo sapiens; identical to SEQ ID NO: 542310
  misc_feature: HIJSMM301E3LLU.22.65.F10.1.454.light.4.raw

SEQ ID NO: 597870 - DNA, 485 bp, Homo sapiens
  misc_feature: HIJSMM301BUBMP.40.69.G03.1.454.light.4.raw
tctagcgactcacgaccggtgctcgatttagtcgctgcgtaaaggagaaagggggaggaactgctcagttaggacccagacggaaccatggaagccccagcgcagcttctcttcctcctgctactctggctcccagatagcgctggagaaatagtgatgacgcagtctccagccaccctgtctgtgtctccagggaaaagagccaccctctcctgcagggccagtgagagtgttgacacctacttagcctggtaccaacacagacctggccaggctcccaggctcctcatctctggtgcatccacccgggccactggtatcccagtcaggttcagtggcagtgggtctgggacagagttcactctcaccatcagcagcctgcagtctgaagatgttgcagtttattcctgtcagcagtaacaatgactggccgtacacttttggccagggaccaagctggagatcaaacgaaatgtggctgcacc

SEQ ID NO: 597871 - DNA, 486 bp, Homo sapiens; identical to SEQ ID NO: 535290
  misc_feature: HIJSMM301AHZG7.3.12.B01.1.454.light.4.raw

SEQ ID NO: 597872 - DNA, 472 bp, Homo sapiens; identical to SEQ ID NO: 541249
  misc_feature: HIJSMM301EWEC9.5.28.C06.1.454.light.4.raw

SEQ ID NO: 597873 - DNA, 521 bp, Homo sapiens; identical to SEQ ID NO: 538715
  misc_feature: HIJSMM301D0S6S.27.23.C01.1.454.light.4.raw

SEQ ID NO: 597874 - DNA, 517 bp, Homo sapiens; identical to SEQ ID NO: 582469
  misc_feature: HIJSMM301C6G0X.19.80.H03.1.454.light.4.raw

SEQ ID NO: 597875 - DNA, 488 bp, Homo sapiens
  misc_feature: HIJSMM301B89AS.17.26.C04.1.454.light.4.raw
cgtagactagcacgaccggtgctcgatttagtctagcgactttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcggcggagggaccaaggtggaggatcaaacgaacctgtggctgcaccta

SEQ ID NO: 597876 - DNA, 492 bp, Homo sapiens
  misc_feature: HIJSMM301CAXVA.40.81.H04.1.454.light.4.raw
tctagcgactcacgaccggtgctcgatttagtagtgtagattcgcggggtgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagattttacactgaaaatcagcagggtggaggcagaagatgttgggatttagttactgcatgcaacctctacaaactgtgtggacggtcggccaagggaccaaggtggaaatcaagcgaactgtggctgca

SEQ ID NO: 597877 - DNA, 502 bp, Homo sapiens; identical to SEQ ID NO: 541384
  misc_feature: HIJSMM301AD81G.14.57.F02.1.454.light.4.raw

SEQ ID NO: 597878 - DNA, 501 bp, Homo sapiens
  misc_feature: HIJSMM301A9BQS.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgccacatctgtctt

SEQ ID NO: 597879 - DNA, 498 bp, Homo sapiens; identical to SEQ ID NO: 540058
  misc_feature: HIJSMM301AS11A.43.28.C06.1.454.light.4.raw

SEQ ID NO: 597880 - DNA, 491 bp, Homo sapiens; identical to SEQ ID NO: 535294
  misc_feature: HIJSMM301C3WS5.16.68.G02.1.454.light.4.raw

SEQ ID NO: 597881 - DNA, 494 bp, Homo sapiens
  misc_feature: HIJSMM301AGKSS.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggacttcggtcggacgggacgaacggtaggagagtacaaacgaacta

SEQ ID NO: 597882 - DNA, 523 bp, Homo sapiens
  misc_feature: HIJSMM301CK1A0.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggcctgccccctcggtcactctcgttcccgccct

SEQ ID NO: 597883 - DNA, 491 bp, Homo sapiens; identical to SEQ ID NO: 535294
  misc_feature: HIJSMM301ENQ7G.16.68.G02.1.454.light.4.raw

SEQ ID NO: 597884 - DNA, 488 bp, Homo sapiens
  misc_feature: HIJSMM301BF10Q.49.23.C01.1.454.light.4.raw
agtcgagagacacgaccggtgctcgatttagtacacgtgattagggattgggggagtcagacccagtcaggacacagcatggacatgagggtccccgctcagctcctggggctcctgctgctctggctcccaggtgccaaatgtgacatccagatgacccagtctccttccaccctgtctgcatttgtaggagacagagtcaccatcacttgccgggccagtcagagtattagtagccggttggcctggcatcagcagaaacccgggaaagcccctaagctcctgatatatgaggcgtccagtttagaaagtggggtcccatcaaggttcagcggcagtggatctgggacagagttcactctcaccatcagcagcctgcagcctgatgattttgcaacttattactgccaacagtataatagttattcgtatacttttggccaggggaccaagctggagatcaaacgaactgtggctgcaccatctgt

SEQ ID NO: 597885 - DNA, 492 bp, Homo sapiens; identical to SEQ ID NO: 537395
  misc_feature: HIJSMM301AT9K5.16.73.G07.1.454.light.4.raw

SEQ ID NO: 597886 - DNA, 523 bp, Homo sapiens
  misc_feature: HIJSMM301CO9HF.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgagggctgattattattgtagttcatatacaaccagtgacacttgggtgttcggcggagggaccaggctgaccgtcctaggtcagcccaaggctgccccctcggtcactctgttccccaccct

SEQ ID NO: 597887 - DNA, 483 bp, Homo sapiens
  misc_feature: HIJSMM301A50XQ.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacgatccggccctcagggatctcagagagattctctgcatccaggtcaggaagcacagcctccctgaccattactggactccaggctgacgacgaagctgattattactgctcagcatggacaccggcctcagtgcgtgggttttcggcggagggaccaagctgaccgtcctaggtcagcccg

SEQ ID NO: 597888 - DNA, 463 bp, Homo sapiens; identical to SEQ ID NO: 535062
  misc_feature: HIJSMM301DSK0I.11.73.G07.1.454.light.4.raw

SEQ ID NO: 597889 - DNA, 404 bp, Homo sapiens; identical to SEQ ID NO: 535779
  misc_feature: HIJSMM301AV1PE.4.35.D02.1.454.light.4.raw

SEQ ID NO: 597890 - DNA, 455 bp, Homo sapiens
  misc_feature: HIJSMM301D6QT7.19.86.H09.1.454.light.4.raw
tactctcgtgcacgaccggtgctcgatttagtgctatagactttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccaccctcctccacgagagta

SEQ ID NO: 597891 - DNA, 496 bp, Homo sapiens; identical to SEQ ID NO: 595974
  misc_feature: HIJSMM301AL2GQ.9.53.E09.1.454.light.4.raw

SEQ ID NO: 597892 - DNA, 480 bp, Homo sapiens
  misc_feature: HIJSMM301BO7NM.7.67.G01.1.454.light.4.raw
cgtgtctctacacgaccggtgctcgatttagagtatacatattgggtttgggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctcccacagcggggcaggttctgatgttcactggtaccagcagcttccagggacagcccccaaactcctcatatacgagaacaccaatccggccctcaggagtccctgaccgattctctggctccaagtctggcacctcagcctccctggccatcactgggctccaggctgaggatgaggctgattattactgccagtcgtatgacagcagcctgagtgtttgggtgttcggcggagggacc

SEQ ID NO: 597893 - DNA, 472 bp, Homo sapiens
  misc_feature: HIJSMM301DT5O8.49.85.H08.1.454.light.4.raw
agtcgagagacacgaccggtgctcgatttagtatcactcagtcgcgggcacgaccggtgctcgatttagtatcactcagtcgcggggtgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggataaatatgctggctggtatcagcagaagccaggccagtcccctgtgttggtcatctatcaagataccaagcggccctcagggatccctgagcgattctctggctccaactctgggaacacagccactctgaccatcagcgggactcgaggctatcgatgaggctgactattactgtcaggcgtgggacagccgcactggggtattc

SEQ ID NO: 597894 - DNA, 501 bp, Homo sapiens; identical to SEQ ID NO: 572732
  misc_feature: HIJSMM301BFJU3.11.21.B10.1.454.light.4.raw

SEQ ID NO: 597895 - DNA, 521 bp, Homo sapiens; identical to SEQ ID NO: 584367
  misc_feature: HIJSMM301APIFL.12.71.G05.1.454.light.4.raw

SEQ ID NO: 597896 - DNA, 491 bp, Homo sapiens; identical to SEQ ID NO: 544055
  misc_feature: HIJSMM301CUV2H.52.85.H08.1.454.light.4.raw

SEQ ID NO: 597897 - DNA, 499 bp, Homo sapiens; identical to SEQ ID NO: 536187
  misc_feature: HIJSMM301B2KZF.11.67.G01.1.454.light.4.raw

SEQ ID NO: 597898 - DNA, 485 bp, Homo sapiens; identical to SEQ ID NO: 539576
  misc_feature: HIJSMM301DQEGM.4.57.F02.1.454.light.4.raw

SEQ ID NO: 597899 - DNA, 474 bp, Homo sapiens
  misc_feature: HIJSMM301CHIWY.12.49.E05.1.454.light.4.raw
  modified_base (439)..(439): a, c, t, g, unknown or other
atacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagcaattttttagcctggtatcagcagaaaccagggaaagttccacacctcctgatctatgctgcatccgctttgcaatcaggggtcccatctcggttcagcggcagtggatctgggacagagttcactctcaccatcagcagcctgcagcctgaagatgttgcaacttattactgtcaaaagtataacagtcgcccccttnaccttcggccaagggacacgactggagattagacg

SEQ ID NO: 597900 - DNA, 509 bp, Homo sapiens; identical to SEQ ID NO: 540142
  misc_feature: HIJSMM301D3IDB.8.38.D05.1.454.light.4.raw

SEQ ID NO: 597901 - DNA, 494 bp, Homo sapiens
  misc_feature: HIJSMM301DRCR9.5.57.F02.1.454.light.4.raw
atcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagaccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgttcggcccagggaccacagtggatatcaggcgaactgtggctgcaccatctgtctt

SEQ ID NO: 597902 - DNA, 447 bp, Homo sapiens; identical to SEQ ID NO: 535020
  misc_feature: HIJSMM301AQCX4.18.9.A09.1.454.light.4.raw

SEQ ID NO: 597903 - DNA, 502 bp, Homo sapiens; identical to SEQ ID NO: 543172
  misc_feature: HIJSMM301EL6EB.18.59.F04.1.454.light.4.raw

SEQ ID NO: 597904 - DNA, 505 bp, Homo sapiens; identical to SEQ ID NO: 535503
  misc_feature: HIJSMM301B4CU0.8.28.C06.1.454.light.4.raw

SEQ ID NO: 597905 - DNA, 507 bp, Homo sapiens
  misc_feature: HIJSMM301D286Y.5.24.C02.1.454.light.4.raw
atcagacacgcacgaccggtgctcgatttagtacagatcgttagggaaagggggggtctcaggaggcagcgctctcaggacgtcaccaccatggcctgggctctgctcctacctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggctccctgaccgtctctgggctccaggctgaggatgaggctgattattactgcagctcatatgcaggcagcagcagtccccatgtgatcttcggacggggggaccaagctgaccgtcctaggtcagcccaaggctgccccccg

SEQ ID NO: 597906 - DNA, 489 bp, Homo sapiens
  misc_feature: HIJSMM301AYQ0J.43.33.C11.1.454.light.4.raw
tgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacgggctctgagacagatttttctctcgtcatcactggtctacagtctgacgacggcgcaatgtacttctgtcaacactatgcctctcccccctacaatttcggtcaggggaccaagttgaacatcaatcgaactgtggctgcaccat

SEQ ID NO: 597907 - DNA, 484 bp, Homo sapiens; identical to SEQ ID NO: 539370
  misc_feature: HIJSMM301B245O.22.73.G07.1.454.light.4.raw

SEQ ID NO: 597908 - DNA, 501 bp, Homo sapiens; identical to SEQ ID NO: 555551
  misc_feature: HIJSMM301BLFXT.21.81.H04.1.454.light.4.raw

SEQ ID NO: 597909 - DNA, 510 bp, Homo sapiens
  misc_feature: HIJSMM301EUPAM.48.53.E09.1.454.light.4.raw
agtatacatacacgaccggtgctcgatttagagagagtgtgttgggtttgggggcagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctctggggtccccgatcggttctctggctccatcgacaggtcctccaactctgcctctctcaccatctctggactgcagactgaggacggagctgtattactactgtcagttcttatgaattaggtggactaaataattggttttggggttggtttcgggcgggaagggaaccgaagtcgtggacccgttccgtaggt

SEQ ID NO: 597910 - DNA, 484 bp, Homo sapiens
  misc_feature: HIJSMM301BYASY.52.22.B11.1.454.light.4.raw
cgcagtacgacacgaccggtgctcgatttagacgacagctcaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcatttgccgggcaagtcagagtattagcagctatttaaattggtatcaacataccccggggaaggcccctaagttactgatctatgctgcagccaatttgcaaagtggggtcccatcaaggttcagtggcagtggatctgggacagaattcactctcaccatcagcagtctgcaacctgaagattttggaaagtactattgtcaacagagttacggaaacttgctcattttcggcggagggaccaaggtggagatcaaacgaactgtggctgcacatctgtctt

SEQ ID NO: 597911 - DNA, 484 bp, Homo sapiens; identical to SEQ ID NO: 536162
  misc_feature: HIJSMM301CH3EG.13.59.F04.1.454.light.4.raw

SEQ ID NO: 597912 - DNA, 505 bp, Homo sapiens
  misc_feature: HIJSMM301A37VG.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggtcggagggaccgaagctgaccgtcctgggtcagcccaaggctgccccctcggtc

SEQ ID NO: 597913 - DNA, 487 bp, Homo sapiens
  misc_feature: HIJSMM301CTZT8.43.53.E09.1.454.light.4.raw
tgtgagtagtcacgaccggtgctcgatttagagagagtgtgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagattttctctcgtcatcactggtctacagtctgacgacggcgcaatgtacttctgtcaacactatgcctctcccccctacaatttcggtcaggggaccaagttgaacatcaatcgaactgtggctgcaccat

SEQ ID NO: 597914 - DNA, 479 bp, Homo sapiens
  misc_feature: HIJSMM301B31I4.11.11.A11.1.454.light.4.raw
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaacctgcaggctgaagatgtggcagtttattactgtcagcagtattgtgaagctccgctcactttcggcggagggaccgcggtggagatcagacgaactgtggctgcaccatctgtcttt

SEQ ID NO: 597915 - DNA, 496 bp, Homo sapiens
  misc_feature: HIJSMM301AD6Q7.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccca

SEQ ID NO: 597916 - DNA, 519 bp, Homo sapiens
  misc_feature: HIJSMM301B1FPM.12.71.G05.1.454.light.4.raw
atacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttgaaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtctaacgtcagcccaaggctgccccctcggtcactctgttcccacct

SEQ ID NO: 597917 - DNA, 509 bp, Homo sapiens
  misc_feature: HIJSMM301CCQ43.43.86.H09.1.454.light.4.raw
tgtgagtagtcacgaccggtgctcgatttagtgctatagacttgggtttgggggatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactctggggtcccagacagattcagcggcagtgggtctggcactgatttcacactgacaatcagcagggtggaggctgaggatgttgggttttattactgcatgcaacttcacactggcctccgttcacttttcggccaggggaccgaaggtggaggatcaaacgaactagtggctgcaccatctgtt

SEQ ID NO: 597918 - DNA, 501 bp, Homo sapiens
  misc_feature: HIJSMM301BMS22.5.24.C02.1.454.light.4.raw
atcagacacgcacgaccggtgctcgatttagtacagatcgttagggaaagggggctggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtctaggtcagcccaaggcc

SEQ ID NO: 597919 - DNA, 499 bp, Homo sapiens
  misc_feature: HIJSMM301CHHLH.48.33.C11.1.454.light.4.raw
agtatacatacacgaccggtgctcgatttagagtgagctcgttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctccg

SEQ ID NO: 597920 - DNA, 488 bp, Homo sapiens
  misc_feature: HIJSMM301BBHBO.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtggggctgaggatgttggcatttattactgcatgcaggctatacaccttcctgccacttttggccaggggaccaagctgggagatcaggcgaacg

SEQ ID NO: 597921 - DNA, 501 bp, Homo sapiens
  misc_feature: HIJSMM301A5UVJ.9.57.F02.1.454.light.4.raw
tgatacgtctcacgaccggtgctcgatttagctcgatatagttgggtttgggggctctgcttcagctgtgggcacaagaggcagcactcaggacaatctccagcatggcctggtctcctctcctcctcactctcctcgctcactgcacagggtcctggggccagtctgtcctgacgcagccggcctcagtatctgggtccccagggcagagggtcaccatctcctgcactgcgaacagctccgacgtcgcgacaccttatattgtacactggtatcaagtacttccagggacagcccccagactcctcatctattctaacaccttccgaccctcaggggttcctgaccgattctctggctcccagtctggcacctcagcctccctggccgtcactgggctccagtctgaggatgaggctgattattactgccagtcctacgacactttcctgagtctttgggtgttcggcggagggaccaagctgaccgtccttcgtcacg

SEQ ID NO: 597922 - DNA, 454 bp, Homo sapiens; identical to SEQ ID NO: 536347
  misc_feature: HIJSMM301AIZKV.19.86.H09.1.454.light.4.raw

SEQ ID NO: 597923 - DNA, 485 bp, Homo sapiens; identical to SEQ ID NO: 570096
  misc_feature: HIJSMM301D32X2.46.35.D02.1.454.light.4.raw

SEQ ID NO: 597924 - DNA, 477 bp, Homo sapiens; identical to SEQ ID NO: 539121
  misc_feature: HIJSMM301CFEJ8.11.17.B06.1.454.light.4.raw

SEQ ID NO: 597925 - DNA, 484 bp, Homo sapiens; identical to SEQ ID NO: 535240
  misc_feature: HIJSMM301AH7SG.47.60.F05.1.454.light.4.raw

SEQ ID NO: 597926 - DNA, 507 bp, Homo sapiens
  misc_feature: HIJSMM301AQHHI.12.48.E04.1.454.light.4.raw
atacgacgtacacgaccggtgctcgatttagagagcgtcacagagagaaggggagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggagccggccccccgactcctcatctttaataacaatcagcggccctcaggggtccctgaccgattctctggctccaagtctggcacctcagcctccctggccatcagtgggctccagtctgaggatgaggctgattattactgtgcatcatgggctgacaccctgactggtccgggagtgttcggcggagggaccaagctgaccgtcctaggtcagcccaaggcacgccccctcggtcactc

SEQ ID NO: 597927 - DNA, 518 bp, Homo sapiens
  misc_feature: HIJSMM301EKRKN.5.27.C05.1.454.light.4.raw
atcagacacgcacgaccggtgctcgatttagacgcgatcgaagggtttgggggtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaacccactgtcactctgttcccaccctcctccgt

SEQ ID NO: 597928 - DNA, 509 bp, Homo sapiens
  misc_feature: HIJSMM301C9J45.8.42.D09.1.454.light.4.raw
ctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctggtcactctgttcccaccctcc

SEQ ID NO: 597929 - DNA, 481 bp, Homo sapiens
  misc_feature: HIJSMM301D6NOQ.52.5.A05.1.454.light.4.raw
cgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattgggggatatacatgtttcctggtatcagcagaagccaggccagtctcctgttctcctcatctataaagatgtcaagcggccctcagggatccctgagcgattctctggctccaattctggaaatgcagccactctgaccatcagcgggacccagcctatggatgaggctgactattactgtcaggcgtgggacagtaggtttgtgtcttttcggcggagggaccaagctgaccgtcctacgtcagcccaaggctgcccctc

SEQ ID NO: 597930 - DNA, 517 bp, Homo sapiens
  misc_feature: HIJSMM301D2XP3.43.81.H04.1.454.light.4.raw
tgtgagtagtcacgaccggtgctcgatttagtagtgtagattcgcggggggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttgggggcaaagctgccctgacactgtcaggtgtgcaccctgaggacgaggctgagtattactgtctgctccactttcgtactgcctgggtcttcggcgggggactcagttgaccgtcctaggtcagccaaggctgccccctcggtcactctgttcccaccctcctcactactca

SEQ ID NO: 597931 - DNA, 481 bp, Homo sapiens
  misc_feature: HIJSMM301CPI1O.11.73.G07.1.454.light.4.raw
  modified_base (448)..(448): a, c, t, g, unknown or other
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccaccgaggttcagtggaagtggatctgggacagactttactctcaccatcagcagcctgcagcctgaagatattgcaacatattactgtcaacagtatgatcgtctcctcaatttcggccctgggaccaggngtacgatgtaacgaaacgtacgtggcgcgtcga

SEQ ID NO: 597932 - DNA, 404 bp, Homo sapiens
  misc_feature: HIJSMM301A1JTO.4.35.D02.1.454.light.4.raw
agcactgtagcacgaccggtgctcgatttagcacacgatagttgggtttggggtttcatgagtgcatggagacggccaggattacttgtgggggagacaacattggagataaaagtgtgcactggtaccagcagaagccaggccaggcccctctgatggtcatctatttcgatagcgaccggccctcaggaatccctgcgcgattctcggggtccaactctgggagcacggccaccctgaccatcagtagtgtcgaagccggtgatgaggccgactatttctgtcaggtgtgggctactcgcagtgacctctgcgtcttcggaagtgggaccaaggtcaccgtcttaggtcagcccaaggccaaccccactgtcactctgttcccgccctcctcctacagtgct

SEQ ID NO: 597933 - DNA, 474 bp, Homo sapiens; identical to SEQ ID NO: 561309
  misc_feature: HIJSMM301EFMZS.5.12.B01.1.454.light.4.raw

SEQ ID NO: 597934 - DNA, 515 bp, Homo sapiens
  misc_feature: HIJSMM301DM65I.22.36.D03.1.454.light.4.raw
acatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaacccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaattaggcgccactctcgtggttttcggcggaggcaccgaagtgaccgtcctcggtcagcccaaggctgccccctggtcactctcg

SEQ ID NO: 597935 - DNA, 498 bp, Homo sapiens
  misc_feature: HIJSMM301EPCSL.8.10.A10.1.454.light.4.raw
ctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaagagccaccctctcctgcagggccagtcttagtgttagcaacttagcctggtaccaacagaaacctggccaggctcccaggctcctcatctctgatacatccaacagggccactggcatcccagccaggttcagtggcagtgggtctgggacagacttcactctcaccatcagcagcgtagagcctgaagattttgcactttattactgtcagcagcgtagtaactggcctttcactttcggccctgggaccaaagtggatatcaaacgaaactgtggctgcaccatctgtcttcatcttcccgccat

SEQ ID NO: 597936 - DNA, 493 bp, Homo sapiens; identical to SEQ ID NO: 572870
  misc_feature: HIJSMM301DAS02.27.78.H01.1.454.light.4.raw

SEQ ID NO: 597937 - DNA, 500 bp, Homo sapiens; identical to SEQ ID NO: 592824
  misc_feature: HIJSMM301CG4YS.14.59.F04.1.454.light.4.raw

SEQ ID NO: 597938 - DNA, 504 bp, Homo sapiens; identical to SEQ ID NO: 538940
  misc_feature: HIJSMM301CN6N6.2.35.D02.1.454.light.4.raw

SEQ ID NO: 597939 - DNA, 499 bp, Homo sapiens
  misc_feature: HIJSMM301AQO1E.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgttaattttcggtgggtagggaccaaaggtggaggtacaaaacgaactagtggctgcaccatctgtcttcatt

SEQ ID NO: 597940 - DNA, 498 bp, Homo sapiens
  misc_feature: HIJSMM301BCGN3.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagggtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaactgtggctgcaccatctgtcttcatcttccccg

SEQ ID NO: 597941 - DNA, 498 bp, Homo sapiens
  misc_feature: HIJSMM301BLT4V.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgactgtgctgcacatctgtctt

SEQ ID NO: 597942 - DNA, 491 bp, Homo sapiens
  misc_feature: HIJSMM301DM92I.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattcctcaccatcagcagcctgcagtctgaagtattttgctaatttattactgtcagcagtataataactggtggacgttcggcgaaggaccaaggtagaaatacaaacgaactgtggctgcaccatctgtt

SEQ ID NO: 597943 - DNA, 488 bp, Homo sapiens
  misc_feature: HIJSMM301CJPC5.10.79.H02.1.454.light.4.raw
catagtagtgcacgaccggtgctcgatttagtgtcacacgaagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgagatttgcagtgtattattgtcagcatatggtaggtcacctggacttttggccagggaccaagctggagatcaaacgaactgtggctgcaccatctgtctt

SEQ ID NO: 597944 - DNA, 501 bp, Homo sapiens
  misc_feature: HIJSMM301EPQ21.53.33.C11.1.454.light.4.raw
cgcgtatacacacgaccggtgctcgatttagagtgagctcgttgggtttggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaagaaaatatgcttattggtaccagcagaggtcaggccaggcccctgtgctggtcatctatgaggacaccaaacgaccctccgggatccctgcgagattctctggcgccagctcagggacagtggccaccctgacagtcagtggggcccaggtggaggatgaagctgattactactgttactcaacagacaggagtggaaatcatagggtattcggcggagggaccaaactgaccgtcctaggtcagcccaaggctgccccctcggtcacc

SEQ ID NO: 597945 - DNA, 473 bp, Homo sapiens; identical to SEQ ID NO: 535262
  misc_feature: HIJSMM301E0FHC.8.67.G01.1.454.light.4.raw

SEQ ID NO: 597946 - DNA, 497 bp, Homo sapiens; identical to SEQ ID NO: 549756
  misc_feature: HIJSMM301EXZAM.40.57.F02.1.454.light.4.raw

SEQ ID NO: 597947 - DNA, 489 bp, Homo sapiens
  misc_feature: HIJSMM301DWN4Y.13.5.A05.1.454.light.4.raw
tcacgtactacacgaccggtgctcgatttagatagatagacaggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagaaatggatatacctatttggattggtatctgcagaagccagggcagtctccacaactcctgatctattggggttctaatcgggcctccggggtccctgacaggttcagtggcagtggatcaggcacagattttacactgaaaatcagcagagtggaggctgaggatgttggggtttattactgcatgcaagctctacaaactctgcggactttcggccctcgggaccgaaacgtaggagatcaaacgaactgtgg

SEQ ID NO: 597948 - DNA, 501 bp, Homo sapiens
  misc_feature: HIJSMM301AXYY7.4.6.A06.1.454.light.4.raw
agcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtctggggcccccggcagagggtcatcctctcttgttctggaggcagctccaacatcggaggacatcctgtgagctggtaccaacacctcccaggaacggcccccaaactcctcatctatacagattctaagaggcccgcaggggtcccagatcgattctctggctccaggtctggcacctcagcctccctgtccatcagtggactccggtctgaggatgaggctgactactattgttcaggatgggattacagcctacatgctcggctgttcggcggagggaccaaactgaccgtcttaggtcagcccaaggctgccccccg

SEQ ID NO: 597949 - DNA, 495 bp, Homo sapiens; identical to SEQ ID NO: 536055
  misc_feature: HIJSMM301A4UJA.47.38.D05.1.454.light.4.raw

SEQ ID NO: 597950 - DNA, 366 bp, Homo sapiens; identical to SEQ ID NO: 575103
  misc_feature: HIJSMM301AYH2P.41.34.D01.1.454.light.4.raw

SEQ ID NO: 597951 - DNA, 505 bp, Homo sapiens
  misc_feature: HIJSMM301BZ24Z.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacgaccgctcactttcggcggagggaccaaggtggagatcaaacgaactgtggctgcaccatctgt

SEQ ID NO: 597952 - DNA, 486 bp, Homo sapiens
  misc_feature: HIJSMM301B7JJX.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctggaccagggtcaccgtcctaggtcacgcccaaggcccaaccc

SEQ ID NO: 597953 - DNA, 444 bp, Homo sapiens
  misc_feature: HIJSMM301EVW3Y.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagttcctttgacattaaactggatgtggtattcggcggagggacccacgtaaccgtcctaggtcagcccaaggctcgccccctcggtcactctcgttcccgccctcctcgtatctctcg

SEQ ID NO: 597954 - DNA, 497 bp, Homo sapiens; identical to SEQ ID NO: 540619
  misc_feature: HIJSMM301ENTX1.15.25.C03.1.454.light.4.raw

SEQ ID NO: 597955 - DNA, 506 bp, Homo sapiens
  misc_feature: HIJSMM301DVJIX.12.53.E09.1.454.light.4.raw
atacgacgtacacgaccggtgctcgatttagagagagtgtgttgggtttggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgggtcagcccaaggctgccccctcggtccactcctgttcccaccctcctctacgtcgtat

SEQ ID NO: 597956 - DNA, 471 bp, Homo sapiens
  misc_feature: HIJSMM301A8O18.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagccaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggccctgggactgaagtgcatatgaagagaactgtgg

SEQ ID NO: 597957 - DNA, 486 bp, Homo sapiens; identical to SEQ ID NO: 554021
  misc_feature: HIJSMM301C0TEA.40.83.H06.1.454.light.4.raw

SEQ ID NO: 597958 - DNA, 511 bp, Homo sapiens
  misc_feature: HIJSMM301AFEGL.13.3.A03.1.454.light.4.raw
tcacgtactacacgaccggtgctcgatttagagagcgtcacaggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaactcattatttacggggtcaataagcggccctcagggctttctgatcgcttctctggctccaagtctggcaacacggcctccctgacaatctctggactccaggccgaggacgaggctgatttttactgttgttcatatgcaggaaggagtgattatgtctttggaagtgggaccaaggtcaccgtccttggtcagcccaaggccaaccccactgtcactctgttccccg

SEQ ID NO: 597959 - DNA, 524 bp, Homo sapiens
  misc_feature: HIJSMM301CWEKZ.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcaaaaaaaaaaaaaaaacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttgtggtgctgtgctattcggcggagggaccaagctgaccgtcttaagtcagcccaaggctgccccctcggtcactctgttcccg

SEQ ID NO: 597960 - DNA, 507 bp, Homo sapiens; identical to SEQ ID NO: 556975
  misc_feature: HIJSMM301CFJPS.7.71.G05.1.454.light.4.raw

SEQ ID NO: 597961 - DNA, 466 bp, Homo sapiens
  misc_feature: HIJSMM301DORI4.13.4.A04.1.454.light.4.raw
tcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagattttactttcaccatcagcagccctgcagcctgaagatattgcaacatattactgtcagcagtatgataatctcccgatcaccttcggccaagggacacgctggagattaaacgaa

SEQ ID NO: 597962 - DNA, 494 bp, Homo sapiens; identical to SEQ ID NO: 535629
  misc_feature: HIJSMM301D38KM.4.27.C05.1.454.light.4.raw

SEQ ID NO: 597963 - DNA, 498 bp, Homo sapiens
  misc_feature: HIJSMM301DLABW.48.85.H08.1.454.light.4.raw
  modified_base (489)..(489): a, c, t, g, unknown or other
agtatacatacacgaccggtgctcgatttagtatcactcagtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcacactgcgattttcggcgggggaccaggctgaccgtcggcggtcagcccaaggctgccccctcggtcacnctgttccca

SEQ ID NO: 597964 - DNA, 523 bp, Homo sapiens
  misc_feature: HIJSMM301AOM9R.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctcgccccctcggtcactctgttcccaccctt

SEQ ID NO: 597965 - DNA, 489 bp, Homo sapiens
  misc_feature: HIJSMM301AJCI3.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgttcttcggtatctgggaccagggtcaccgtcctaggtcagcccaaggccaacccca

SEQ ID NO: 597966 - DNA, 491 bp, Homo sapiens
  misc_feature: HIJSMM301AMHOF.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcacttattactgtcagcagcgtagcaactggcctctcactttcggcggagggaccagggtggaggatcagacgaactgtggctgcaccatctgtt

SEQ ID NO: 597967 - DNA, 485 bp, Homo sapiens
  misc_feature: HIJSMM301B1MMK.43.33.C11.1.454.light.4.raw
tgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagtatttttctctcgtcatcactggtctacagtctgacgacggcgcaatgtacttctgtcaacactatgcctctcccccctacaatttcggtcaggggaccaagttgaacatcaatcgaactgtgctgcacatc

SEQ ID NO: 597968 - DNA, 519 bp, Homo sapiens
  misc_feature: HIJSMM301C1CLU.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggccaagggaccgaacggtaggaagtacgaaacgaactacgtggcgtgcaccactctcgtcttctatcttccgccatctgat

SEQ ID NO: 597969 - DNA, 447 bp, Homo sapiens; identical to SEQ ID NO: 535020
  misc_feature: HIJSMM301BVXI5.18.9.A09.1.454.light.4.raw

SEQ ID NO: 597970 - DNA, 493 bp, Homo sapiens
  misc_feature: HIJSMM301DJ3H9.52.38.D05.1.454.light.4.raw
  modified_base (463)..(463): a, c, t, g, unknown or other
cgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcacgtcngggtcagcccaaggccaacccactgtcact

SEQ ID NO: 597971 - DNA, 491 bp, Homo sapiens
  misc_feature: HIJSMM301BC7QR.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggggtcccgccaagattcagcggcagtggatctggcacagatttcactctcaccgtcagcagcctgcagtctgaagattttgcaacttattactgtctacaagattataaataccctcggacgttcggtccagggaccgaacggtggatgtcaagcgaactgtggctgcaccatctgtctt

SEQ ID NO: 597972 - DNA, 502 bp, Homo sapiens
  misc_feature: HIJSMM301B5U1T.21.22.B11.1.454.light.4.raw
  modified_base (414)..(414): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccagtccgaggatgaggctgactattacngtgcatcacgggacgcaacatgggatgacaatctgagcggttgggtgttcggcggagggaccaaactgaccgtcctaggtcagacccg

SEQ ID NO: 597973 - DNA, 499 bp, Homo sapiens
  misc_feature: HIJSMM301CJSQD.3.31.C09.1.454.light.4.raw
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcaactacttagcctggtaccaacagaaacctggccaggctcccaggctcctcatctatgatgcatccaacagggccactggcatcccagccaggttcaggtggcaggtgggtctgggacagacttcactctcaccatcagcagcctagagcctgaagtattttgctagtttattactgtcagcagcgtagcaactggcctctcactttcggcggagggaccgaaggtggagatcaaacgaactgtggctgcacatctgtctt

SEQ ID NO: 597974 - DNA, 517 bp, Homo sapiens
  misc_feature: HIJSMM301D5G7L.48.17.B06.1.454.light.4.raw
agtatacatacacgaccggtgctcgatttagtcgatagtgaaggggggggtcacaagaggcagcgctctcgggacgtctccaccatggcctgggctctgctgctcctcaccctcctcactcaggacacagggtcctgggcccaggctgccctgactcagccagcctccgtgtctgcctctcctggacagtcggtcaatctttcctgcactggaaccgcctatgacattggaaaatataaccttgtctcctggtaccagcaacacccaggcaaagcccccaaattaattatttatacggtcaataagagaccgtcaggggtctctgctcgcttctctgggtccaagtctggcgacacggcctccctcacaatctctgggctccaggctgacgacgaggcttcctattgctgctcctcatatgtaggatccggctcttatctgattttcggcggagggaccaagctgaccgtcctacgtcagcccaaggctgccccctcggtcactctgttcccaccct

SEQ ID NO: 597975 - DNA, 514 bp, Homo sapiens; identical to SEQ ID NO: 554167
  misc_feature: HIJSMM301CHVSG.40.12.B01.1.454.light.4.raw

SEQ ID NO: 597976 - DNA, 499 bp, Homo sapiens
  misc_feature: HIJSMM301CXY9C.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccacggctatggatgaggctgactattactagtcaggcggtggcgatcagcagtgaggtggtttgggttcggacggggaccggaaacgacgtcgaccggtaccctaacgtacgtacgacccg

SEQ ID NO: 597977 - DNA, 512 bp, Homo sapiens
  misc_feature: HIJSMM301C93HD.8.42.D09.1.454.light.4.raw
ctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaaacagggtattcggcggagggaccaaagttgaaccgtcctaggtcagcccaaggctgccccctcggtcactcctgttcccgccct

SEQ ID NO: 597978 - DNA, 500 bp, Homo sapiens
  misc_feature: HIJSMM301DUEWM.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccgaagctgaccgtcctaggtcagcccaaggct

SEQ ID NO: 597979 - DNA, 487 bp, Homo sapiens
  misc_feature: HIJSMM301A1XB2.48.27.C05.1.454.light.4.raw
agtatacatacacgaccggtgctcgatttagacgcgatcgaagggtttgggggcagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctctggggtccccgatcggttctctggctccatcgacaggtcctccaactctgcctctctcaccatctctggactgcagactgaggacgaggctgattactactgtcagtcttatgatagtggcaataatgtttgggtgtttggcggagggaccaagctgaccgtcctaggtcacg

SEQ ID NO: 597980 - DNA, 521 bp, Homo sapiens
  misc_feature: HIJSMM301B6AB0.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctcgttccgccct

SEQ ID NO: 597981 - DNA, 481 bp, Homo sapiens
  misc_feature: HIJSMM301C8964.13.39.D06.1.454.light.4.raw
tcacgtactacacgaccggtgctcgatttagtgacatctcgcagttctttggggtgctggggtctcaggaggcagcgctctcaggacatctccaccatggcctgggctctgctgctcctcaccctcctcactcagggcacagggtcctgggcccagtctgccctgactcagcctgcctccgtgtctggctctcctggacagtcgatcatcgtctcctgcactggaaccagcactgatgttggtggttataactatgtctcctggtatcaacaacacccaggcaaagcccccaaactcatcatttatgaagtcatttatcggccctcagggatttctaatcgcttctctggctccaagtctggcaacacggcctccctgaccatctctgggctccaggctgaagacgaggctgattattactgcagctcatatacaaccatcaacacacaggtcttcggaagtgggaccaaagtcacgtcct

SEQ ID NO: 597982 - DNA, 511 bp, Homo sapiens
  misc_feature: HIJSMM301ECL5D.8.42.D09.1.454.light.4.raw
ctcgcgtgtccacgaccggtgctcgatttagacacatacgcagggaaaggggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctcggtcactctgttcccgccctcc

SEQ ID NO: 597983 - DNA, 482 bp, Homo sapiens
  misc_feature: HIJSMM301C5TEJ.13.39.D06.1.454.light.4.raw
tcacgtactacacgaccggtgctcgatttagtgacatctcgcagttctttggggtgctggggtctcaggaggcagcgctctcaggacatctccaccatggcctgggctctgctgctcctcaccctcctcactcagggcacagggtcctgggcccagtctgccctgactcagcctgcctccgtgtctggctctcctggacagtcgatcatcgtctcctgcactggaaccagcactgatgttggtggttataactatgtctcctggtatcaacaacacccaggcaaagcccccaaactcatcatttatgaagtcatttatcggccctcagggatttctaatcgcttctctggctccaagtctggcaacacggcctccctgaccatctctgggctccaggctgaagacgaggctgattattactgcagctcatatacaaccatcaacacacaggtcttcggaagtgggaccaaagtcaccgtcct

SEQ ID NO: 597984 - DNA, 492 bp, Homo sapiens
  misc_feature: HIJSMM301A3CB3.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtaggagggaccgaaaggtggaggtcaaacgaaactgtggctgcaccatctgtcttc

SEQ ID NO: 597985 - DNA, 501 bp, Homo sapiens; identical to SEQ ID NO: 592148
  misc_feature: HIJSMM301B61YH.48.69.G03.1.454.light.4.raw

SEQ ID NO: 597986 - DNA, 494 bp, Homo sapiens
  misc_feature: HIJSMM301B7UJQ.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttatactgtcatcagagtactactttacctcaagtgatcaccttcggccaagggacacgactggagattaaaacgaactgtggctgcaccatctgtctt

SEQ ID NO: 597987 - DNA, 504 bp, Homo sapiens; identical to SEQ ID NO: 535935
  misc_feature: HIJSMM301EB38B.18.78.H01.1.454.light.4.raw

SEQ ID NO: 597988 - DNA, 489 bp, Homo sapiens; identical to SEQ ID NO: 553074
  misc_feature: HIJSMM301EB0B2.14.33.C11.1.454.light.4.raw

SEQ ID NO: 597989 - DNA, 484 bp, Homo sapiens
  misc_feature: HIJSMM301BO1UB.4.34.D01.1.454.light.4.raw
agcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggctcctcatctatggtgcatccaccagggccactggtatcccagccaggttcagtgccagtgggtctgggacagagttcactctcaccatcagcagcctgcagtctgaagattttgtcggtttattactgtcagcagtatgataactggctgtacacttttggccaggggaccaagctggagatcaggcgaactgtggctgcta

SEQ ID NO: 597990 - DNA, 502 bp, Homo sapiens; identical to SEQ ID NO: 537298
  misc_feature: HIJSMM301BL431.27.78.H01.1.454.light.4.raw

SEQ ID NO: 597991 - DNA, 502 bp, Homo sapiens; identical to SEQ ID NO: 543913
  misc_feature: HIJSMM301A6WHE.18.26.C04.1.454.light.4.raw

SEQ ID NO: 597992 - DNA, 503 bp, Homo sapiens; identical to SEQ ID NO: 547049
  misc_feature: HIJSMM301DDYVG.18.59.F04.1.454.light.4.raw

SEQ ID NO: 597993 - DNA, 472 bp, Homo sapiens
  misc_feature: HIJSMM301DKFFI.15.81.H04.1.454.light.4.raw
tctacgtagccacgaccggtgctcgatttagtagtgtagattcgcgggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgccccctcggtcactctgttcccgccctcctcgcacgtaga

SEQ ID NO: 597994 - DNA, 488 bp, Homo sapiens; identical to SEQ ID NO: 535990
  misc_feature: HIJSMM301BH4LI.11.28.C06.1.454.light.4.raw

SEQ ID NO: 597995 - DNA, 509 bp, Homo sapiens; identical to SEQ ID NO: 547302
  misc_feature: HIJSMM301EXC9F.4.57.F02.1.454.light.4.raw

SEQ ID NO: 597996 - DNA, 517 bp, Homo sapiens
  misc_feature: HIJSMM301EJXLR.12.71.G05.1.454.light.4.raw
atacgacgtacacgaccggtgctcgatttagtgtcgtcgcaagagagagggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgaggacactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagcccaaggctgccccctcggtcactctgttcccaccct

SEQ ID NO: 597997 - DNA, 497 bp, Homo sapiens
  misc_feature: HIJSMM301C1SD3.22.65.F10.1.454.light.4.raw
acatacgcgtcacgaccggtgctcgatttagctacgctctaagggggagtcagtctcagtcaggacacagcatggacatgagggtccccgctcacctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgccccccgatcaccttcggccaagggacacgactggagattaaacgaactgtggctgcaccatctgtcttcatcttccccg

SEQ ID NO: 597998 - DNA, 473 bp, Homo sapiens; identical to SEQ ID NO: 538875
  misc_feature: HIJSMM301EQQ7B.4.75.G09.1.454.light.4.raw

SEQ ID NO: 597999 - DNA, 495 bp, Homo sapiens
  misc_feature: HIJSMM301CVD2F.9.19.B08.1.454.light.4.raw
tgatacgtctcacgaccggtgctcgatttagtgagtcagtaagggggcttcagctgtgggcacaagaggcagcactcaggacaatctccagcatgccctggtctcctctcctcctcactctcctcgctcactgcacagggtcctgggcccagtctgtgctgacgcagccgccctcagtgtctggggccccagggcagagggtcaccatctcctgcactggcagcagttccaacatcggggcaggttatgatgtccactggtaccagcagtttccaggaacagcccccagggtcctcatctttggttacagtaatcggccctcaggggtccctgaccgattctctggctccaagtctgacacctcagcctccctggccatcactgggctccagactgaggatgaggctcattattactgccagtcttatgacaaacgtcagaactagtttgggtgttcggcggagggaccaagctgaccgtcctcagtcagacccg

SEQ ID NO: 598000 - DNA, 504 bp, Homo sapiens; identical to SEQ ID NO: 535561
  misc_feature: HIJSMM301EOZ4C.4.57.F02.1.454.light.4.raw

SEQ ID NO: 598001 - DNA, 505 bp, Homo sapiens
  misc_feature: HIJSMM301B9IMJ.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaacaaaatagaggtcgaaacgaacgtgtggctgcaccatctgtcttcatt

SEQ ID NO: 598002 - DNA, 491 bp, Homo sapiens; identical to SEQ ID NO: 547784
  misc_feature: HIJSMM301AK6HX.8.53.E09.1.454.light.4.raw

SEQ ID NO: 598003 - DNA, 485 bp, Homo sapiens; identical to SEQ ID NO: 535688
  misc_feature: HIJSMM301CVDRP.19.5.A05.1.454.light.4.raw

SEQ ID NO: 598004 - DNA, 493 bp, Homo sapiens
  misc_feature: HIJSMM301DORJQ.13.5.A05.1.454.light.4.raw
tcacgtactacacgaccggtgctcgatttagatagatagacaggggacacaagctcagctgtaactgtgccttgactgatcaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaaacctctgcggactttcggcctcggacgaaacg

SEQ ID NO: 598005 - DNA, 499 bp, Homo sapiens
  misc_feature: HIJSMM301BUJSE.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcagtgggtcaggcgctgatttcacactgagaatcagcagggtggaggctgaagatgtcggggtttattactgcatgcagggtacagtgtggccttcgctcgcattcggcggagggaccgaaggtggagatcaaacgaactagtggctg

SEQ ID NO: 598006 - DNA, 354 bp, Homo sapiens
  misc_feature: HIJSMM301CNMTT.40.9.A09.1.454.light.4.raw
tctagcgactcacgaccggtgctcgatttagcgagacgcgcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccatagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcacca

SEQ ID NO: 598007 - DNA, 508 bp, Homo sapiens
  misc_feature: HIJSMM301C2ZFJ.7.34.D01.1.454.light.4.raw
cgtgtctctacacgaccggtgctcgatttagatcgtctgtgttgggtttgggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacagcattatttgggtgttcggcggagggaccaagctgaccgtcctgcgtcagccaagctgcccctccggtcact

SEQ ID NO: 598008 - DNA, 495 bp, Homo sapiens; identical to SEQ ID NO: 557386
  misc_feature: HIJSMM301AGBST.27.78.H01.1.454.light.4.raw

SEQ ID NO: 598009 - DNA, 508 bp, Homo sapiens; identical to SEQ ID NO: 560800
  misc_feature: HIJSMM301D41P1.17.33.C11.1.454.light.4.raw

SEQ ID NO: 598010 - DNA, 510 bp, Homo sapiens
  misc_feature: HIJSMM301AGDZX.43.15.B04.1.454.light.4.raw
tgtgagtagtcacgaccggtgctcgatttagacagtatatatccgcgggggaggaactgctcagttaggacccagacggaaccatggaagccccagcgcagcttctcttcctcctgctactctggctcccagaaaccactggagaaatagtgatgacgcagtctccagccaccctgtctttgtctccaggggaaagagccaccctctcatgcagggccagtcagagtgttagcaccaacgtggcctggtaccagcagaaacctggccagcctccccggctcctcatctctggtgcatcctccagggccactggttccccagccaggttcagtggcagtgggtctgggacagagttcactctcaccatcagcagccttcagtctgaagattttgctagttttattactgtcaccagtatcataactggcctccgaagggggactttcggccaagggaccgaaggtggaattcaaccgaactgtggctgcaccatctgtcttcatcttcccg

SEQ ID NO: 598011 - DNA, 496 bp, Homo sapiens
  misc_feature: HIJSMM301DGILG.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcaggcgggtctgggacagatttcactctcaccatcagcagcctgcaggttgaagatgtggcagtttattactgtcagcagtattatactactcctctgacgttcggccaagggaccaagggtggagatcaaacgaactgtggctgcaccat

SEQ ID NO: 598012 - DNA, 484 bp, Homo sapiens; identical to SEQ ID NO: 535400
  misc_feature: HIJSMM301AR1WT.46.26.C04.1.454.light.4.raw

SEQ ID NO: 598013 - DNA, 481 bp, Homo sapiens; identical to SEQ ID NO: 535993
  misc_feature: HIJSMM301BMGRH.21.25.C03.1.454.light.4.raw

SEQ ID NO: 598014 - DNA, 493 bp, Homo sapiens
  misc_feature: HIJSMM301C7BY0.52.82.H05.1.454.light.4.raw
cgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggacactgagaggccctcagggatccctgagcgattctctggctccacctcagggacactagtcacgttgaccatcagtggagtccaggcagaggacgaggctgactaccactgtcaatcaacagacagcagtggttcttatgtcttcgcaactgggaccaaggtcaccgtcctaggtcagcccaaggcccaaccccactgtcact

SEQ ID NO: 598015 - DNA, 495 bp, Homo sapiens; identical to SEQ ID NO: 541828
  misc_feature: HIJSMM301DO8JD.19.71.G05.1.454.light.4.raw

SEQ ID NO: 598016 - DNA, 488 bp, Homo sapiens
  misc_feature: HIJSMM301DW8X4.4.59.F04.1.454.light.4.raw
agcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcacctgctctggagataaattgggccataaatttgcttcctggtatcagcagaagccaggccagtcccctatactggtcatctatcaagataccaagcggccctcagggatccctgagcgattctctggctccaattctgggaacacagccactctgaccatcaccgggacccaggctgtagatgaggctgactattactgtcaggcgtgggacagcagcactgaggtgttcggcggagggaccaagctgaccgtcctaggtcagcccaaggctgccccccg

SEQ ID NO: 598017 - DNA, 510 bp, Homo sapiens; identical to SEQ ID NO: 556652
  misc_feature: HIJSMM301AO613.17.28.C06.1.454.light.4.raw

SEQ ID NO: 598018 - DNA, 491 bp, Homo sapiens; identical to SEQ ID NO: 543372
  misc_feature: HIJSMM301CQGSP.47.55.E11.1.454.light.4.raw

SEQ ID NO: 598019 - DNA, 506 bp, Homo sapiens; identical to SEQ ID NO: 534969
  misc_feature: HIJSMM301DH1H1.18.37.D04.1.454.light.4.raw

SEQ ID NO: 598020 - DNA, 502 bp, Homo sapiens
  misc_feature: HIJSMM301CBEMG.3.37.D04.1.454.light.4.raw
agacgcactccacgaccggtgctcgatttagtagcatactgtttggggtttggggggggtcgtcaggaggcagcgctctcaggacgtcaccaccatggcctgggcgtctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctcctgaccgtctctgggctccagcctgaggatgaggctgattattactgcagctcatatgcaggcatcaacactgttttcggcggagggaccaagctgaccgtcctaggtcagcccaaggctgtccccccg

SEQ ID NO: 598021 - DNA, 490 bp, Homo sapiens
  misc_feature: HIJSMM301BHB84.48.28.C06.1.454.light.4.raw
agtatacatacacgaccggtgctcgatttagagctcacgtattgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacatactcgcacgcaagtactgttcggcggagggaccaagctgacagtcctaggtcagcccaaggctgcccccg

SEQ ID NO: 598022 - DNA, 478 bp, Homo sapiens
  misc_feature: HIJSMM301DYU1L.8.85.H08.1.454.light.4.raw
ctcgcgtgtccacgaccggtgctcgatttagtatcactcagtcgcgggggagtcagtctcagtcaggacacagcatggacatgagggtccccgctcagctcctggggctcctgctactctggctccgaggtgccagatgtgacatccagatgacccagtctccatcctccctgtctgcatctgtcggagacagagtcaccatcacttgtcgggcaagtcagactataaataattatttaaattggtatcagcagaaaccagggaacgcccctaagctcctcatatattctgcattcactttgcaaagtggggtcccatcaaggttcagtggcagtggatctgggacagatttcactctcaccatccgcagtctgcaacctgaagattttgcaatttattactgtcaagagactcacaatggaggcacttttggccaggggaccaaagctggagaggaaacgaactgtggctgcaccat

SEQ ID NO: 598023 - DNA, 506 bp, Homo sapiens
  misc_feature: HIJSMM301C9GUQ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttatactgtcaacagttttctcgggcgttcggccgaacgggaccgaaggtaggaaatcaaacgaactagtggctgcaccatctgtcttcatcttccccg

SEQ ID NO: 598024 - DNA, 497 bp, Homo sapiens; identical to SEQ ID NO: 535886
  misc_feature: HIJSMM301BT2GB.8.10.A10.1.454.light.4.raw

SEQ ID NO: 598025 - DNA, 481 bp, Homo sapiens; identical to SEQ ID NO: 535993
  misc_feature: HIJSMM301AJ43R.21.25.C03.1.454.light.4.raw

SEQ ID NO: 598026 - DNA, 505 bp, Homo sapiens
  misc_feature: HIJSMM301EZEYW.17.87.H10.1.454.light.4.raw
cgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccaacaccacccagacaaagcccccaaactcatcctttatgagggcactaagcggccctcaggggtttctaatcgcttcgctggctccacgtctggcagcacggcctccctgacaatctctgggctccaggctgaggacgaggctgattattactgctgctcatattcaagtcgtgtcactatgatttttggcggaggcaccaaggtgaccgtcctaggtcagcccaaggctcgccccctcggt

SEQ ID NO: 598027 - DNA, 496 bp, Homo sapiens
  misc_feature: HIJSMM301B4NGL.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaaactgtggctgcaccaatctgtcttcatcttccccg

SEQ ID NO: 598028 - DNA, 492 bp, Homo sapiens
  misc_feature: HIJSMM301ETG84.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaacgggaccgaaagtaggacgatacaagacgaactagtggctgcacca

SEQ ID NO: 598029 - DNA, 513 bp, Homo sapiens; identical to SEQ ID NO: 535244
  misc_feature: HIJSMM301DRHX7.17.33.C11.1.454.light.4.raw

SEQ ID NO: 598030 - DNA, 489 bp, Homo sapiens; identical to SEQ ID NO: 535386
  misc_feature: HIJSMM301AF7B1.12.51.E07.1.454.light.4.raw

SEQ ID NO: 598031 - DNA, 509 bp, Homo sapiens
  misc_feature: HIJSMM301CD2Q4.43.57.F02.1.454.light.4.raw
tgtgagtagtcacgaccggtgctcgatttagctcgatatagttgggtttgggcacgaccggtgctcgatttagctcgatatagttgggtttggggctttgcctgggctctgctcctcctcaccctcctcactcagggcacagggtcctgggcccagtctgccctgactcagcctccctccgcgtccgggtcccctggacagtcagtcaccatctcctgcactggaagcagcagtgacattggtggttatacatatgtctcctggtaccaacagcacccaggcaaagcccccaaactcatgatttatgaggtcaataagcggccgtcaggggtccctgatcgcttctctggctccaagtctggcaacacggccaccctgaccgtctctgggctccaggctgaggatgaggctcattattactgcagctcatatacaggcaacaagaatttggtgttcggcggagggaccgagctgaccgtcctaggtcagcccaaggctgccccctcggt

SEQ ID NO: 598032 - DNA, 488 bp, Homo sapiens
  misc_feature: HIJSMM301EM3L0.43.60.F05.1.454.light.4.raw
tgtgagtagtcacgaccggtgctcgatttagtacgtcatcagggaaaggggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggtccacggggaccgacggtcggagtgtcaagcgaactgtggctgcaccat

SEQ ID NO: 598033 - DNA, 499 bp, Homo sapiens; identical to SEQ ID NO: 537857
  misc_feature: HIJSMM301AGC3Q.52.34.D01.1.454.light.4.raw

SEQ ID NO: 598034 - DNA, 495 bp, Homo sapiens
  misc_feature: HIJSMM301BUQSF.19.83.H06.1.454.light.4.raw
tactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactagaaaatcaacagagtggaggctgaggatgttggggtttattactgcatgcaagctctacaaactccctcaacgttcggcggagggaccaaaggtggagatacaaacgaactgtgctgcaccatctgtcttcta

SEQ ID NO: 598035 - DNA, 444 bp, Homo sapiens; identical to SEQ ID NO: 540477
  misc_feature: HIJSMM301BMJYE.17.21.B10.1.454.light.4.raw

SEQ ID NO: 598036 - DNA, 491 bp, Homo sapiens; identical to SEQ ID NO: 538021
  misc_feature: HIJSMM301D40UH.3.72.G06.1.454.light.4.raw

SEQ ID NO: 598037 - DNA, 494 bp, Homo sapiens; identical to SEQ ID NO: 534994
  misc_feature: HIJSMM301BHE6W.27.78.H01.1.454.light.4.raw

SEQ ID NO: 598038 - DNA, 505 bp, Homo sapiens
  misc_feature: HIJSMM301AVCPF.14.55.E11.1.454.light.4.raw
  modified_base (425)..(425): a, c, t, g, unknown or other
  modified_base (485)..(485): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccncctctacgtacggtcgggacggacggacgaggagatacacgacgaacgtagtggtcgtcncgacctactcttcgttctta

SEQ ID NO: 598039 - DNA, 489 bp, Homo sapiens; identical to SEQ ID NO: 535386
  misc_feature: HIJSMM301EL2UG.12.51.E07.1.454.light.4.raw

SEQ ID NO: 598040 - DNA, 484 bp, Homo sapiens; identical to SEQ ID NO: 535400
  misc_feature: HIJSMM301CISUF.46.26.C04.1.454.light.4.raw

SEQ ID NO: 598041 - DNA, 488 bp, Homo sapiens; identical to SEQ ID NO: 561192
  misc_feature: HIJSMM301C93M6.21.55.E11.1.454.light.4.raw

SEQ ID NO: 598042 - DNA, 496 bp, Homo sapiens
  misc_feature: HIJSMM301DJZJL.49.22.B11.1.454.light.4.raw
agtcgagagacacgaccggtgctcgatttagacgacagctcaggggggaactgctcagttaggacccagagggaaccatggaagccccagctcagcttctcttcctcctgctactctggctcccagatatttccgaagaaattgtgttgacacagtctccagccaccctctatctgtctccaggggaaagagccaccctctcctgcagggccagtcagagtgttaacaacttcttaggctggtatcaacaaaaacctggccaggttcccaggctcctcgtctatgatgcgtccatcagggccactggcatcccagccaggttcagtggcagtgggtctgggacagacttcactctcaccatcagcagcctagagcctgaagactttgcagtttattactgtcagcagcgtagcaatttgatcaccttcggccaagggacacgactaggaaattaaacgaactgtggctgcaccatctgtcttcatcttcccgccat

SEQ ID NO: 598043 - DNA, 486 bp, Homo sapiens; identical to SEQ ID NO: 535043
  misc_feature: HIJSMM301DP27G.46.35.D02.1.454.light.4.raw

SEQ ID NO: 598044 - DNA, 462 bp, Homo sapiens; identical to SEQ ID NO: 541820
  misc_feature: HIJSMM301DVN1J.4.39.D06.1.454.light.4.raw

SEQ ID NO: 598045 - DNA, 484 bp, Homo sapiens
  misc_feature: HIJSMM301BWOWD.48.49.E05.1.454.light.4.raw
agtatacatacacgaccggtgctcgatttagagcgactagcaacacacaaagggggaggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatttcctgcactgggaccagctccaacatcggcgtaggttatgatgtacactggtaccagcaacttccaggaacagtccccagactcctcatctatgataacaacaatcggccctcaggggtccctgaccggttctctggctccaagtctggcacctcagcctccctggccatcactgggctccagactgaggatgaggctgattattactgccagtcctatgacagcaacctgagcggttggtgttcggcggagggacca

SEQ ID NO: 598046 - DNA, 493 bp, Homo sapiens
  misc_feature: HIJSMM301DRKMH.19.71.G05.1.454.light.4.raw
tactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctggagatgtggcagtttattattgtcaacaatattattatacttcgtggacgttcggccaagggaccaaggtggagtatcagacgaactgtgg

SEQ ID NO: 598047 - DNA, 461 bp, Homo sapiens
  misc_feature: HIJSMM301DWIKJ.18.59.F04.1.454.light.4.raw
tacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaacccactgtcactctgttcccgccctcctccaatcgta

SEQ ID NO: 598048 - DNA, 482 bp, Homo sapiens; identical to SEQ ID NO: 539800
  misc_feature: HIJSMM301BY68E.21.25.C03.1.454.light.4.raw

SEQ ID NO: 598049 - DNA, 478 bp, Homo sapiens; identical to SEQ ID NO: 543315
  misc_feature: HIJSMM301ECGTU.26.72.G06.1.454.light.4.raw

SEQ ID NO: 598050 - DNA, 504 bp, Homo sapiens
  misc_feature: HIJSMM301C4UGE.48.38.D05.1.454.light.4.raw
agtatacatacacgaccggtgctcgatttagtatctgatagttgggtttggggggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgttagcagcgtgccaactggcctctcacgttcggcggagggaccaaggtggacatcaaacgaactgtggctgcaccatctgtcttcatcttcccgccta

SEQ ID NO: 598051 - DNA, 490 bp, Homo sapiens; identical to SEQ ID NO: 536481
  misc_feature: HIJSMM301DDDVL.13.46.E02.1.454.light.4.raw

SEQ ID NO: 598052 - DNA, 477 bp, Homo sapiens; identical to SEQ ID NO: 580835
  misc_feature: HIJSMM301AKQJ6.11.11.A11.1.454.light.4.raw

SEQ ID NO: 598053 - DNA, 492 bp, Homo sapiens; identical to SEQ ID NO: 573597
  misc_feature: HIJSMM301A52X5.10.72.G06.1.454.light.4.raw

SEQ ID NO: 598054 - DNA, 503 bp, Homo sapiens; identical to SEQ ID NO: 548067
  misc_feature: HIJSMM301BNKBL.9.53.E09.1.454.light.4.raw

SEQ ID NO: 598055 - DNA, 494 bp, Homo sapiens; identical to SEQ ID NO: 534994
  misc_feature: HIJSMM301AOTHG.27.78.H01.1.454.light.4.raw

SEQ ID NO: 598056 - DNA, 497 bp, Homo sapiens; identical to SEQ ID NO: 559774
  misc_feature: HIJSMM301EOKWK.10.28.C06.1.454.light.4.raw

SEQ ID NO: 598057 - DNA, 507 bp, Homo sapiens
  misc_feature: HIJSMM301B4XZL.15.56.F01.1.454.light.4.raw
tctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggactttacaaccttgtctcctggtaccaacatcacccaggcaaagcccccaaactcatgatttatgaggacaatgagcggccctcaggggtttctaatcgcttctctggctccaagtctgacaacacggcctccctgacaatctctgggctccaggctgaggacgagggtgattattactgctgcgcatatagaagtcccactgttgtacttttcggcggagggaccaagctgaccgtcctaggtcagcccaaggctgccccctcggtccactcctgttccccaccctccctcgcctacgtaga

SEQ ID NO: 598058 - DNA, 503 bp, Homo sapiens; identical to SEQ ID NO: 568393
  misc_feature: HIJSMM301A2NXM.48.71.G05.1.454.light.4.raw

SEQ ID NO: 598059 - DNA, 484 bp, Homo sapiens; identical to SEQ ID NO: 535240
  misc_feature: HIJSMM301AJQ1A.47.60.F05.1.454.light.4.raw

SEQ ID NO: 598060 - DNA, 522 bp, Homo sapiens; identical to SEQ ID NO: 540226
  misc_feature: HIJSMM301CZUCG.27.23.C01.1.454.light.4.raw

SEQ ID NO: 598061 - DNA, 490 bp, Homo sapiens
  misc_feature: HIJSMM301AZGZR.5.23.C01.1.454.light.4.raw
  modified_base (485)..(485): a, c, t, g, unknown or other
atcagacacgcacgaccggtgctcgatttagtacacgtgattagggattgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgtcgggcaagtcagagtgttagtatttatttaaattggtatcagttcaaaccagggaaagcccctaagctcctgatctatgctgcatccagtttacaaagtggggtcccatcaaggttcagtggcagtggatctgggacagatttcactctcaccatcagtagtctacaacctgaagattttgcaactttactactgtcaaacagagttacgatacccctccgctcactttcggcggagggaccaaggtggagatcaaacgaaactgtggctgnaccat

SEQ ID NO: 598062 - DNA, 492 bp, Homo sapiens
  misc_feature: HIJSMM301CDT5X.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcatcatcaatagcctggaagctgaagatgctgcaacttattactgtcatcagagtactactttacctcaagtgatcaccttcggccaagggacacgactggagattaaacgaactgtggctgcaccatctgtt

SEQ ID NO: 598063 - DNA, 385 bp, Homo sapiens; identical to SEQ ID NO: 539030
  misc_feature: HIJSMM301CIW73.49.34.D01.1.454.light.4.raw

SEQ ID NO: 598064 - DNA, 523 bp, Homo sapiens; identical to SEQ ID NO: 548013
  misc_feature: HIJSMM301AWL9B.27.23.C01.1.454.light.4.raw

SEQ ID NO: 598065 - DNA, 502 bp, Homo sapiens; identical to SEQ ID NO: 558110
  misc_feature: HIJSMM301DR2FC.4.6.A06.1.454.light.4.raw

SEQ ID NO: 598066 - DNA, 517 bp, Homo sapiens
  misc_feature: HIJSMM301CUR2N.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtctagtcagcccaaggctgcccctcggtcactctgttccgccct

SEQ ID NO: 598067 - DNA, 447 bp, Homo sapiens; identical to SEQ ID NO: 535020
  misc_feature: HIJSMM301BBFIQ.18.9.A09.1.454.light.4.raw

SEQ ID NO: 598068 - DNA, 521 bp, Homo sapiens
  misc_feature: HIJSMM301C5TYS.12.71.G05.1.454.light.4.raw
atacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagcccaaggctgccccctcggtcactctgttcccacctt

SEQ ID NO: 598069 - DNA, 505 bp, Homo sapiens; identical to SEQ ID NO: 571264
  misc_feature: HIJSMM301DIA6L.19.78.H01.1.454.light.4.raw

SEQ ID NO: 598070 - DNA, 507 bp, Homo sapiens; identical to SEQ ID NO: 535641
  misc_feature: HIJSMM301DVKZO.10.88.H11.1.454.light.4.raw

SEQ ID NO: 598071 - DNA, 494 bp, Homo sapiens; identical to SEQ ID NO: 534994
  misc_feature: HIJSMM301EWYQY.27.78.H01.1.454.light.4.raw

SEQ ID NO: 598072 - DNA, 500 bp, Homo sapiens
  misc_feature: HIJSMM301CIP3K.22.5.A05.1.454.light.4.raw
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctggccaggctcccaggctcctcatctatgatgcatcttacagggccactggcatcccagccaggttcagtggcagtgggtctgggacagacttcactctcaccatcagcagcctagagcctgaagattttgcagtttattactgtcagcagcgtagcaactccctcacgttcggcggagggaccaaggtggagatcaaacgaactgtggctgcaccatctgtcttcatcttcccgccattcc

SEQ ID NO: 598073 - DNA, 484 bp, Homo sapiens; identical to SEQ ID NO: 535211
  misc_feature: HIJSMM301AHDEC.47.46.E02.1.454.light.4.raw

SEQ ID NO: 598074 - DNA, 501 bp, Homo sapiens
  misc_feature: HIJSMM301DRLG8.19.71.G05.1.454.light.4.raw
tactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggtcatctacccgggaatccggggtccctgaccgattcagtggcagcgggtctgggacagatttcactctcaccatcagcagcctgcaggctgaagatgtggcagtttatattgtcaacaatattattatacttcgtggacgttcggcctaagggaccaaggtggattatcagacgaactgtggctggctaccg

SEQ ID NO: 598075 - DNA, 506 bp, Homo sapiens
  misc_feature: HIJSMM301DJV26.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcagccaaggctgccccccg

SEQ ID NO: 598076 - DNA, 481 bp, Homo sapiens; identical to SEQ ID NO: 535993
  misc_feature: HIJSMM301BMBX7.21.25.C03.1.454.light.4.raw

SEQ ID NO: 598077 - DNA, 495 bp, Homo sapiens; identical to SEQ ID NO: 536487
  misc_feature: HIJSMM301B11CM.52.86.H09.1.454.light.4.raw

SEQ ID NO: 598078 - DNA, 490 bp, Homo sapiens; identical to SEQ ID NO: 560335
  misc_feature: HIJSMM301D792F.3.33.C11.1.454.light.4.raw

SEQ ID NO: 598079 - DNA, 521 bp, Homo sapiens
  misc_feature: HIJSMM301DYFZT.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctggaccgtcctaggtcagcccaaggctgcccctcggtcactctgttcccaccct

SEQ ID NO: 598080 - DNA, 494 bp, Homo sapiens
  misc_feature: HIJSMM301BHP7F.48.3.A03.1.454.light.4.raw
agtatacatacacgaccggtgctcgatttagagagcgtcacagggggagtcagacccagtcaggacacagcatggacatgagggtccccgctcagctcctggggctcctgctgctctggctcccaggtgccaagtgtgccatccagatgacccagtctccttccaccctgtctgcatctgtgggagacagcgtcaccatcacttgccgggccagtcagaatattaatgactggttggcctggtatcaacagaaaccagggaaagcccctaaacttctgatctttcaggcatctaatttagaacatggggtcccatcaaggttcagcggcagtgggtttggcacagacttcactctcaccatcgccagcctgcagcccgatgattttgcaacttatttctgccaacaatacaccactttgtggacgttcggccgggggaccgaacggtggagatcaagcgaactgtggctgcaccatctgtcttcatcttcccgt

SEQ ID NO: 598081 - DNA, 493 bp, Homo sapiens; identical to SEQ ID NO: 536769
  misc_feature: HIJSMM301CTZEC.19.83.H06.1.454.light.4.raw

SEQ ID NO: 598082 - DNA, 483 bp, Homo sapiens
  misc_feature: HIJSMM301BXCMT.51.76.G10.1.454.light.4.raw
cgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgaagatttgcaatttattactgtcagcagtataataactggcctccgtacacttttggccgaggggaccaagctggagatcaaacgaactgtcggctgcaccta

SEQ ID NO: 598083 - DNA, 447 bp, Homo sapiens; identical to SEQ ID NO: 535020
  misc_feature: HIJSMM301D0XTE.18.9.A09.1.454.light.4.raw

SEQ ID NO: 598084 - DNA, 493 bp, Homo sapiens; identical to SEQ ID NO: 543949
  misc_feature: HIJSMM301CKUX0.16.68.G02.1.454.light.4.raw

SEQ ID NO: 598085 - DNA, 489 bp, Homo sapiens; identical to SEQ ID NO: 560672
  misc_feature: HIJSMM301CLEFP.19.71.G05.1.454.light.4.raw

SEQ ID NO: 598086 - DNA, 490 bp, Homo sapiens
  misc_feature: HIJSMM301DIOSS.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaaagggcctgcgacagaccgcaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaaacacagcctccctgaccattactggacttccagcctgaggacgaggctgactattactgctcagcatgggacagcggcctcaggacttatgtcttcggaacttgggacccacgttaccgtcctaggtcagccccg

SEQ ID NO: 598087 - DNA, 503 bp, Homo sapiens
  misc_feature: HIJSMM301B74TG.21.22.B11.1.454.light.4.raw
  modified_base (429)..(429): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacncaacatgggatgacaatctgagcggttgggtgttcggcggagggaccaaactgaccgtcctaggtccagcccaa

SEQ ID NO: 598088 - DNA, 505 bp, Homo sapiens; identical to SEQ ID NO: 546412
  misc_feature: HIJSMM301DE9OS.22.21.B10.1.454.light.4.raw

SEQ ID NO: 598089 - DNA, 446 bp, Homo sapiens
  misc_feature: HIJSMM301A4N1F.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctcgtttcccaccctcctccgtgtctgat

SEQ ID NO: 598090 - DNA, 467 bp, Homo sapiens
  misc_feature: HIJSMM301DKG5H.51.34.D01.1.454.light.4.raw
cgatcgtatacacgaccggtgctcgatttagatcgtctgtgttgggtttggggcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggcggggggaccaacggtggaggatcaagcgaa

SEQ ID NO: 598091 - DNA, 495 bp, Homo sapiens
  misc_feature: HIJSMM301BOCCT.51.35.D02.1.454.light.4.raw
cgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttggaactgcgaccaaggtcaccgtcctgggtcagcccaaggccaaccccactgtcact

SEQ ID NO: 598092 - DNA, 483 bp, Homo sapiens; identical to SEQ ID NO: 571177
  misc_feature: HIJSMM301DJYGO.17.26.C04.1.454.light.4.raw

SEQ ID NO: 598093 - DNA, 483 bp, Homo sapiens
  misc_feature: HIJSMM301DUJI4.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtccaagaacttttggccagggccaagctggagatcaaacgactagtggctgcaccat

SEQ ID NO: 598094 - DNA, 499 bp, Homo sapiens
  misc_feature: HIJSMM301C7KL9.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagtattttgtcggtttattactgtcagcagtataataactggcctccacggtactactttggccagggaccaagctggagatacaaacgaactgtggctgcaccatctgtt

SEQ ID NO: 598095 - DNA, 505 bp, Homo sapiens
  misc_feature: HIJSMM301CCEK8.48.26.C04.1.454.light.4.raw
agtatacatacacgaccggtgctcgatttagtctagcgactttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaagggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggcctgccccctcggt

SEQ ID NO: 598096 - DNA, 454 bp, Homo sapiens; identical to SEQ ID NO: 536642
  misc_feature: HIJSMM301BEDEU.19.86.H09.1.454.light.4.raw

SEQ ID NO: 598097 - DNA, 470 bp, Homo sapiens; identical to SEQ ID NO: 535302
  misc_feature: HIJSMM301BVDNK.13.76.G10.1.454.light.4.raw

SEQ ID NO: 598098 - DNA, 473 bp, Homo sapiens; identical to SEQ ID NO: 538060
  misc_feature: HIJSMM301ADJGY.18.76.G10.1.454.light.4.raw

SEQ ID NO: 598099 - DNA, 489 bp, Homo sapiens
  misc_feature: HIJSMM301DM477.5.15.B04.1.454.light.4.raw
atcagacacgcacgaccggtgctcgatttagacagtatatatccgcgggggtcagactcagtcaggacacagcatggacatgagggtccccgctcagctcctggggctcctgctgctctggctcccaggtgccaaatgtgacatccagatgacccagtctccttccaccctgtctgcatctataggagacagagtcaccatcacttgccgggccagtcagagtattagtaactggttggcctggtatcagcagaaaccaggcaaagccccaaagctccttatctctgatgcctccactttgcacggtggggtcccaccaacgttcagcggcagtggatctgggacagatttcactctcaccatcagtagtctacaacctgaagattttgcaacttactactgtcaacagagttacgatacccctccgctcactttcggcggagggaccaaggtggagatcaaacgaactgtggctgcaccatctgtctt

SEQ ID NO: 598100 - DNA, 475 bp, Homo sapiens; identical to SEQ ID NO: 537714
  misc_feature: HIJSMM301AVDR9.7.81.H04.1.454.light.4.raw

SEQ ID NO: 598101 - DNA, 525 bp, Homo sapiens
  misc_feature: HIJSMM301CYLDT.17.41.D08.1.454.light.4.raw
  modified_base (475)..(475): a, c, t, g, unknown or other
  modified_base (515)..(515): a, c, t, g, unknown or other
cgtagactagcacgaccggtgctcgatttagtcacgcgagaaagggaaaggggagagaagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagtgtttttaaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgtctctgtatcactgtcagcaatatggtggtacacccctccacttcgtcggcgggcggacggtaggaggagtanagacgacacgtggcgtcgtcgaccactctcgtcttctctnttccctcccg

SEQ ID NO: 598102 - DNA, 487 bp, Homo sapiens; identical to SEQ ID NO: 540237
  misc_feature: HIJSMM301BXHAA.47.67.G01.1.454.light.4.raw

SEQ ID NO: 598103 - DNA, 507 bp, Homo sapiens; identical to SEQ ID NO: 567918
  misc_feature: HIJSMM301DNRFC.4.10.A10.1.454.light.4.raw

SEQ ID NO: 598104 - DNA, 497 bp, Homo sapiens; identical to SEQ ID NO: 535664
  misc_feature: HIJSMM301CK9N2.22.14.B03.1.454.light.4.raw

SEQ ID NO: 598105 - DNA, 486 bp, Homo sapiens
  misc_feature: HIJSMM301BB8XG.51.76.G10.1.454.light.4.raw
cgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgaagtattttgctaatttattactgtcagcagtataataactggcctccgtactacttttggccgagggaccaagctggagatacaaacgaactgtggctgcaccta

SEQ ID NO: 598106 - DNA, 485 bp, Homo sapiens; identical to SEQ ID NO: 540394
  misc_feature: HIJSMM301BW250.46.26.C04.1.454.light.4.raw

SEQ ID NO: 598107 - DNA, 383 bp, Homo sapiens; identical to SEQ ID NO: 447524
  misc_feature: HIJSMM301DOVV5.41.26.C04.1.454.light.4.raw

SEQ ID NO: 598108 - DNA, 463 bp, Homo sapiens; identical to SEQ ID NO: 535062
  misc_feature: HIJSMM301BO3UZ.11.73.G07.1.454.light.4.raw

SEQ ID NO: 598109 - DNA, 490 bp, Homo sapiens; identical to SEQ ID NO: 535420
  misc_feature: HIJSMM301CIKWS.3.72.G06.1.454.light.4.raw

SEQ ID NO: 598110 - DNA, 479 bp, Homo sapiens; identical to SEQ ID NO: 558912
  misc_feature: HIJSMM301DO7W7.40.23.C01.1.454.light.4.raw

SEQ ID NO: 598111 - DNA, 519 bp, Homo sapiens; identical to SEQ ID NO: 555040
  misc_feature: HIJSMM301EQH8D.40.27.C05.1.454.light.4.raw

SEQ ID NO: 598112 - DNA, 498 bp, Homo sapiens
  misc_feature: HIJSMM301BKN71.48.29.C07.1.454.light.4.raw
agtatacatacacgaccggtgctcgatttagagtgctacgaagggaaaggggatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaagggacacgactggagattaaacgactgtggctgcaccatctgtcttcatcttcccgcc

SEQ ID NO: 598113 - DNA, 505 bp, Homo sapiens
  misc_feature: HIJSMM301B65PT.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagacgcgttggtagtagcttacactggtaccagcagaagccaggtcagtctccaaagctcctcatcaagtatgcttcccagtccttctcaggggtcccctcgaggttcagtggcagtggatctgggacacatttccaccctcaccatcaatagcctggaagctgaagatgctgcaacttattactgtcatcagagtactactttacctcaagtgatcaccttcggccaagggacacgactggagattaaacg

SEQ ID NO: 598114 - DNA, 504 bp, Homo sapiens
  misc_feature: HIJSMM301C35FQ.8.28.C06.1.454.light.4.raw
ctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttattctgtcagcagtctgaagactggccgttcactttcggcggagggaccaaggtggacctcaaacgaactgtggctgcaccatctgtcttcatcttccgcc

SEQ ID NO: 598115 - DNA, 485 bp, Homo sapiens; identical to SEQ ID NO: 536576
  misc_feature: HIJSMM301CC8EE.46.35.D02.1.454.light.4.raw

SEQ ID NO: 598116 - DNA, 515 bp, Homo sapiens
  misc_feature: HIJSMM301CKEHR.41.55.E11.1.454.light.4.raw
tctatactatcacgaccggtgctcgatttagcactcgcacgttgggtttgggggggcctaaggaagcagcactggtggtgcctcagccatggcctggaccgttctcctcctcggcctcctctctcactgcacagcctctgtgacctcctatgtgttgactcagccaccctcggcgtcagtggccctaggacagacggccaggattacctgtggggcaaataagataggaactacaaatgtgcactggtaccaacagaggccaggccaggcccctgtggtggtcgtccatgatgattacgaccggccctcaggaatccctgagcgattctctggctccaattctgggaacacggccaccctgaccatcaccggggtcgaggccggggatgaggccacctactattgtcacgtctgggagactggtgatgatcctgtggcgctattcggcggagggacgaagctgaccgtcctgggtcagcccaaggctgccccctcggtcactctgttcccaccct

SEQ ID NO: 598117 - DNA, 505 bp, Homo sapiens
  misc_feature: HIJSMM301DTZ1J.16.49.E05.1.454.light.4.raw
tgtactactccacgaccggtgctcgatttagagcgactagcaacacacaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccagcagcacccagacaaagcccccaaactcatgatttatgagggcaataagcggccctcaggagtttctaatcgcttctctggctccacgtctggcaacacggcctccctgacaatctctggcctccaggctgaggacgaggctgattattactgctgctcatattcaagtcgtgtcactatgctttttggtcggagggaccaaggtgaccgtcctaggtcagcccaaggctgtccccccg

SEQ ID NO: 598118 - DNA, 483 bp, Homo sapiens
  misc_feature: HIJSMM301EJQE3.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggtttttggctgttcggtcggcgggacc

SEQ ID NO: 598119 - DNA, 514 bp, Homo sapiens; identical to SEQ ID NO: 554167
  misc_feature: HIJSMM301C4C3G.40.12.B01.1.454.light.4.raw

SEQ ID NO: 598120 - DNA, 484 bp, Homo sapiens; identical to SEQ ID NO: 550343
  misc_feature: HIJSMM301BVYKP.40.81.H04.1.454.light.4.raw

SEQ ID NO: 598121 - DNA, 510 bp, Homo sapiens; identical to SEQ ID NO: 538614
  misc_feature: HIJSMM301EG1SL.19.59.F04.1.454.light.4.raw

SEQ ID NO: 598122 - DNA, 492 bp, Homo sapiens
  misc_feature: HIJSMM301ELS4W.4.6.A06.1.454.light.4.raw
agcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtctggggcccccgggcagagggtcatcctctcttgttctggaggcagctccaacatcggaggacatcctgtgagctggtaccaacacctcccaggaacggcccccaaactcctcatctatacagattctaagaggcccgcaggggtcccagatcgattctctggctccaggtctggcacctcagcctcctgtccatcagtggactccggtctgaggatgaggctgactactattgttcaggatgggattacagcctacatgctcggctgttcggcggagggaccaaactgaccgtcttaggtcagcccaaggc

SEQ ID NO: 598123 - DNA, 511 bp, Homo sapiens
  misc_feature: HIJSMM301DBWMT.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcacagcactctctatgtctacgacgtcggaacgacgtccaccgtcgtcgtacacgaccgaacggacccaacccactcgt

SEQ ID NO: 598124 - DNA, 503 bp, Homo sapiens
  misc_feature: HIJSMM301C0PPN.19.85.H08.1.454.light.4.raw
tactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagccaaggctcgccccctcggt

SEQ ID NO: 598125 - DNA, 491 bp, Homo sapiens
  misc_feature: HIJSMM301EGCFG.41.33.C11.1.454.light.4.raw
tctatactatcacgaccggtgctcgatttagagtgagctcgttgggtttgggggaggaactgctcagttaggacccagacggaaccatggaagccccagcgcagcttctcttcctcctgctactctggctcccagataccactgcagaaatactgatgacgcagtctccagccaccctgtctgtgtctccaggagaaagagtcaccctctcctgcagggccagtcagagtgctggcagcaacttagcctggtatcagcagaaacctggccaggctcccaggctcctcatctctggtgcttccacccgggacactggtatcccagccaggttcagtggcagtgggtctgggacagagttcactctcaccatcagcactctacagtctgaggattatgcagtttactactgtctgcagtataaagactggcctagggtctactttcggcccgtcggaccgaaagtggtattcaaacgaactagtggctgcacc

SEQ ID NO: 598126 - DNA, 481 bp, Homo sapiens; identical to SEQ ID NO: 576555
  misc_feature: HIJSMM301AGI7V.40.59.F04.1.454.light.4.raw

SEQ ID NO: 598127 - DNA, 505 bp, Homo sapiens; identical to SEQ ID NO: 539634
  misc_feature: HIJSMM301C2F9Z.48.78.H01.1.454.light.4.raw

SEQ ID NO: 598128 - DNA, 488 bp, Homo sapiens
  misc_feature: HIJSMM301EWAZV.47.67.G01.1.454.light.4.raw
agctcacgtacacgaccggtgctcgatttagagtatacatattgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccaggggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggccaggggaccaagctggagatcaaacgaa

SEQ ID NO: 598129 - DNA, 488 bp, Homo sapiens; identical to SEQ ID NO: 537260
  misc_feature: HIJSMM301BEM8X.47.70.G04.1.454.light.4.raw

SEQ ID NO: 598130 - DNA, 505 bp, Homo sapiens
  misc_feature: HIJSMM301D0WD2.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgagatttgcagtatattactgtcaacatcgtaccgagtggcctccgggggccactttcggccctgggaccaaagtggatatcaaacgaactgtggctgcaccatctgtcttcatcttccgcc

SEQ ID NO: 598131 - DNA, 515 bp, Homo sapiens; identical to SEQ ID NO: 571713
  misc_feature: HIJSMM301AK71I.22.36.D03.1.454.light.4.raw

SEQ ID NO: 598132 - DNA, 496 bp, Homo sapiens
  misc_feature: HIJSMM301B3P7W.40.57.F02.1.454.light.4.raw
tctagcgactcacgaccggtgctcgatttagctcgatatagttgggtttgggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaacccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgctgctcttatgcaggcagtttcgctctcgaagtgttcggcggagggccgagctgaccgtcctacgtcagcccaaggctcg

SEQ ID NO: 598133 - DNA, 463 bp, Homo sapiens; identical to SEQ ID NO: 535062
  misc_feature: HIJSMM301DZOKW.11.73.G07.1.454.light.4.raw

SEQ ID NO: 598134 - DNA, 497 bp, Homo sapiens; identical to SEQ ID NO: 535740
  misc_feature: HIJSMM301CFNP8.3.71.G05.1.454.light.4.raw

SEQ ID NO: 598135 - DNA, 454 bp, Homo sapiens; identical to SEQ ID NO: 534964
  misc_feature: HIJSMM301CE8WE.19.86.H09.1.454.light.4.raw

SEQ ID NO: 598136 - DNA, 502 bp, Homo sapiens; identical to SEQ ID NO: 541971
  misc_feature: HIJSMM301A8H1T.4.39.D06.1.454.light.4.raw

SEQ ID NO: 598137 - DNA, 511 bp, Homo sapiens; identical to SEQ ID NO: 550438
  misc_feature: HIJSMM301DCYOS.17.33.C11.1.454.light.4.raw

SEQ ID NO: 598138 - DNA, 509 bp, Homo sapiens; identical to SEQ ID NO: 543772
  misc_feature: HIJSMM301AQVX8.2.21.B10.1.454.light.4.raw

SEQ ID NO: 598139 - DNA, 502 bp, Homo sapiens; identical to SEQ ID NO: 541971
  misc_feature: HIJSMM301BUOXB.4.39.D06.1.454.light.4.raw

SEQ ID NO: 598140 - DNA, 478 bp, Homo sapiens; identical to SEQ ID NO: 535129
  misc_feature: HIJSMM301DHV11.11.11.A11.1.454.light.4.raw

SEQ ID NO: 598141 - DNA, 493 bp, Homo sapiens; identical to SEQ ID NO: 537281
  misc_feature: HIJSMM301C3QRI.9.1.A01.1.454.light.4.raw

SEQ ID NO: 598142 - DNA, 513 bp, Homo sapiens
  misc_feature: HIJSMM301D17AQ.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccaaggaccgaaggtaggaagtacgaacgaactagtggctggcaccactctcgtcttctatcttcccgtcccact

SEQ ID NO: 598143 - DNA, 487 bp, Homo sapiens
  misc_feature: HIJSMM301AS9H4.40.12.B01.1.454.light.4.raw
tctagcgactcacgaccggtgctcgatttagtagtgtagattccgcggggtgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagattttacactgaaaatcagcagggtggaggcagaagatgttgggatttattactgcatgcaacctctacaaactgtgtggacggtcggccaagggaccaaggtggaaatcaagcgaactgtgg

SEQ ID NO: 598144 - DNA, 497 bp, Homo sapiens
  misc_feature: HIJSMM301CE4US.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaaatattatattcctcctcagacgttcggccaagggaccaaggtggaaatcaaacgactgtggctgcacca

SEQ ID NO: 598145 - DNA, 484 bp, Homo sapiens; identical to SEQ ID NO: 535400
  misc_feature: HIJSMM301BD98R.46.26.C04.1.454.light.4.raw

SEQ ID NO: 598146 - DNA, 518 bp, Homo sapiens
  misc_feature: HIJSMM301BTJPL.48.17.B06.1.454.light.4.raw
agtatacatacacgaccggtgctcgatttagtcgatagtgaaggggggggtcacaagaggcagcgctctcgggacgtctccaccatggcctgggctctgctgctcctcaccctcctcactcaggacacagggtcctgggcccaggctgccctgactcagccagcctccgtgtctgcctctcctggacagtcggtcaatctttcctgcactggaaccgcctatgacattggaaaatataaccttgtctcctggtaccagcaacacccaggcaaagcccccaaattaattatttatacggtcaataagagaccgtcaggggtctctgctcgcttctctgggtccaagtctggcgacacggcctccctcacaatctctgggctccaggctgacgacgaggcttcctattgctgctcctcatatgtaggatccggctcttatctgattttcggcggagggaccaagctgaccgtcctacgtcagcccaaggctgccccctcggtcactctgttcccaccctt

SEQ ID NO: 598147 - DNA, 455 bp, Homo sapiens; identical to SEQ ID NO: 550155
  misc_feature: HIJSMM301BUC7H.5.86.H09.1.454.light.4.raw

SEQ ID NO: 598148 - DNA, 495 bp, Homo sapiens
  misc_feature: HIJSMM301D32PI.19.71.G05.1.454.light.4.raw
tactctcgtgcacgaccggtgctcgatttagtgtcgtcgcaagagagaggggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttggccaagggaccaaggtggatatcagacgaactgtggctgca

SEQ ID NO: 598149 - DNA, 487 bp, Homo sapiens
  misc_feature: HIJSMM301DLTN1.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggcccatcagtggggctccggtccgaggatgaggctgattattattgtgcaacatgggatagtagcctgagtagtgtggttttcggcggagggaccaaactgaccgtcctaggtcagcccaaggctgccccctcggtcactctgttcccaccctcctctacgtgagct

SEQ ID NO: 598150 - DNA, 507 bp, Homo sapiens; identical to SEQ ID NO: 588234
  misc_feature: HIJSMM301DGMKB.19.78.H01.1.454.light.4.raw

SEQ ID NO: 598151 - DNA, 505 bp, Homo sapiens
  misc_feature: HIJSMM301DEO5P.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgaatcaccttcggcccaagggacacgactggagattaaacg

SEQ ID NO: 598152 - DNA, 511 bp, Homo sapiens
  misc_feature: HIJSMM301C6TIZ.9.55.E11.1.454.light.4.raw
tgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaaacatcattggaggtgttagtgtacactggtaccagcagaagccaggccaggcccctgtgctggtcctccatcatactagcgaccggccctcagggatccctgagcgattctcaggctccaactctgggaaaacggccaccctgacccatcagcagggtcgaagccggggatgaggccgactattactgtcaggtgtgggctggtgataatgatcatgcgggggtgttcggcggagggaccaagctgaccgtcctaagtcagcccaaggctgccccctcggtcactcttcgg

SEQ ID NO: 598153 - DNA, 498 bp, Homo sapiens
  misc_feature: HIJSMM301DT7P6.14.35.D02.1.454.light.4.raw
cgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtaccaacagaaaccaggacagtctcctaagttgctcattttctgggcatctacccgggaatccggggtccctgagcgattcagtggcagcgggtctgggacagatttcactttcaccatcagcagcctgcaggctgaagatgtggcagtttattactgtcagcaatattatagtactccctacacttttggccagggaccaagctggagatcaaacgaactgtggctgcacc

SEQ ID NO: 598154 - DNA, 494 bp, Homo sapiens
  misc_feature: HIJSMM301B2GUY.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaacaccttcggccaagggacacgactggagattaaaggaactagtggctgcaccatctgtcttcatcttccccg

SEQ ID NO: 598155 - DNA, 487 bp, Homo sapiens; identical to SEQ ID NO: 537009
  misc_feature: HIJSMM301ESXQH.12.88.H11.1.454.light.4.raw

SEQ ID NO: 598156 - DNA, 503 bp, Homo sapiens; identical to SEQ ID NO: 536834
  misc_feature: HIJSMM301ATW7D.2.35.D02.1.454.light.4.raw

SEQ ID NO: 598157 - DNA, 476 bp, Homo sapiens; identical to SEQ ID NO: 556448
  misc_feature: HIJSMM301B9U3T.41.39.D06.1.454.light.4.raw

SEQ ID NO: 598158 - DNA, 495 bp, Homo sapiens; identical to SEQ ID NO: 535821
  misc_feature: HIJSMM301CBI4S.3.31.C09.1.454.light.4.raw

SEQ ID NO: 598159 - DNA, 510 bp, Homo sapiens; identical to SEQ ID NO: 595420
  misc_feature: HIJSMM301B1LAS.17.33.C11.1.454.light.4.raw

SEQ ID NO: 598160 - DNA, 517 bp, Homo sapiens; identical to SEQ ID NO: 552807
  misc_feature: HIJSMM301C237N.10.26.C04.1.454.light.4.raw

SEQ ID NO: 598161 - DNA, 487 bp, Homo sapiens
  misc_feature: HIJSMM301A7XVO.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaaggaccgaaggtaggatatcagacgaa

SEQ ID NO: 598162 - DNA, 499 bp, Homo sapiens
  misc_feature: HIJSMM301AP5MI.48.45.E01.1.454.light.4.raw
agtatacatacacgaccggtgctcgatttagtgagtcagtaagggaaagggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaagggacacgactggagattaaacgaactgtggctgcaccatctgtcttcatcttcccg

SEQ ID NO: 598163 - DNA, 500 bp, Homo sapiens
  misc_feature: HIJSMM301BY6II.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccca

SEQ ID NO: 598164 - DNA, 520 bp, Homo sapiens
  misc_feature: HIJSMM301DY14D.49.9.A09.1.454.light.4.raw
agtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcagggatccctgagcgattttctggctccaagtctgggaacacggccaccctgaccgtcagcagggtcgaagccggggatgaggccgactatatctgtcaggtgtgggatagtagtagtgctcttccgggggtgttcggcggagggaccaagttgaccgtcgttggtcagcccaaggctgccccctggtcactctgttcccgccctcctctctctcg

SEQ ID NO: 598165 - DNA, 485 bp, Homo sapiens
  misc_feature: HIJSMM301CQXF2.15.8.A08.1.454.light.4.raw
tctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgcagtctgaagattttgcagtttattactgtcagcaaatataacaagtggccattcactttcggcccagggaccaaagtggatatcaaacgaactgtggctgcaccatctgtcttcattcttcccgccatctgagctaacg

SEQ ID NO: 598166 - DNA, 489 bp, Homo sapiens
  misc_feature: HIJSMM301CCUH7.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatagaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaaacaattattattatacttcgtggacgttcggccaagggaccaaggtggatatcagacgaa

SEQ ID NO: 598167 - DNA, 476 bp, Homo sapiens
  misc_feature: HIJSMM301D5C8B.12.1.A01.1.454.light.4.raw
atacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtgggtcccatcaaggttcagtggcagtgggtctgggacagatttcactctcaccatcagcagtctgcaacctgaagattctgcaacttattactgtcaacagagtaacagttaccctcccactttcggcggagggaccaaggtggagatcaaacgaactgtggctgca

SEQ ID NO: 598168 - DNA, 469 bp, Homo sapiens
  misc_feature: HIJSMM301C75BO.51.38.D05.1.454.light.4.raw
cgatcgtatacacgaccggtgctcgatttagtatctgatagttgggtttgggatagttgggtttgggggctttgcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcatatacaatcaataacaattgggtgttcggcggagggaccaaactgaccgtcctaggtcagcccaaggctgccccctcggtcactctgttcccaccctcctctcgtagcact

SEQ ID NO: 598169 - DNA, 492 bp, Homo sapiens
  misc_feature: HIJSMM301BBG0K.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaaacgaactgtggctgcaccatctgtcttcatt

SEQ ID NO: 598170 - DNA, 505 bp, Homo sapiens
  misc_feature: HIJSMM301BYUV8.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtctaggtcagcccaaggccaacccactgt

SEQ ID NO: 598171 - DNA, 489 bp, Homo sapiens; identical to SEQ ID NO: 535139
  misc_feature: HIJSMM301EXSUP.14.55.E11.1.454.light.4.raw

SEQ ID NO: 598172 - DNA, 496 bp, Homo sapiens; identical to SEQ ID NO: 549958
  misc_feature: HIJSMM301B60NU.10.25.C03.1.454.light.4.raw

SEQ ID NO: 598173 - DNA, 493 bp, Homo sapiens
  misc_feature: HIJSMM301C8Y1D.16.86.H09.1.454.light.4.raw
tgtactactccacgaccggtgctcgatttagtgctatagacttgggtttggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtcctaggtcagcccaagg

SEQ ID NO: 598174 - DNA, 502 bp, Homo sapiens
  misc_feature: HIJSMM301CXOS2.12.12.B01.1.454.light.4.raw
atacgacgtacacgaccggtgctcgatttagtagtgtagattccgcgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagctgcattgccaataaaatctccttattggtaccagcagaagtcaggccaggcccctgtattggtcatctatgaggacaacagacgaccttccgggatccctgagagattctctggctccacctcagggacaatggccaccttgactatcagtggcgcccaggtggaggatgaggctggactactattgttattcaacagacagcactacaagtcattgggtgttcggcggagggaccaagctgaccgtcctacgtcagcccaaggctgccccctcggtcactctgtt

SEQ ID NO: 598175 - DNA, 454 bp, Homo sapiens; identical to SEQ ID NO: 534964
  misc_feature: HIJSMM301DYYWB.19.86.H09.1.454.light.4.raw

SEQ ID NO: 598176 - DNA, 496 bp, Homo sapiens
  misc_feature: HIJSMM301BSWUI.40.33.C11.1.454.light.4.raw
tctagcgactcacgaccggtgctcgatttagagtgagctcgttgggtttggggagctgggaagcctgagaacacttggccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaagctgccctcaccattacgggggcccagccagaggatgagtcttattattactgcatgctccatgtgggggtgccacttgggtgttcggcggagggaccaagctgaccgtcctaggtcagcccaagg

SEQ ID NO: 598177 - DNA, 490 bp, Homo sapiens; identical to SEQ ID NO: 535234
  misc_feature: HIJSMM301DA5WD.17.21.B10.1.454.light.4.raw

SEQ ID NO: 598178 - DNA, 503 bp, Homo sapiens
  misc_feature: HIJSMM301BIINR.48.14.B03.1.454.light.4.raw
agtatacatacacgaccggtgctcgatttagtgtgagtagttccgcgggcacgaccggtgctcgatttagagagagtgtgttggggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaagggtccctgatcgcttctctggctccaagtctggcaacacggcctccctgaccgtctctgggctccaggctgaggatgaggctgattattactgcagctcatatgcaggcagcaacaatgtggtattcggcggagggacc

SEQ ID NO: 598179 - DNA, 446 bp, Homo sapiens
  misc_feature: HIJSMM301AOM26.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccctccccatactcgta

SEQ ID NO: 598180 - DNA, 502 bp, Homo sapiens
  misc_feature: HIJSMM301BD2CP.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggccttaggggtccctgatcgcttctctggctccaagtctggcagaacggcctcctgaccgtctctgggctccaagctgaggatgaggctgattattactgcagctcatatgcaggcagcagcaatgtacttttcggcggaggaccaagctgaccgtcctgggtcagcccaaggctcgccccctcggtcta

SEQ ID NO: 598181 - DNA, 500 bp, Homo sapiens
  misc_feature: HIJSMM301BD0ZH.52.28.C06.1.454.light.4.raw
cgcagtacgacacgaccggtgctcgatttagagctcacgtattgggtttgggggaggaactgctcagttaggacccagagggaaccatggaagccccagctcagcttctcttcctcctgctactctggctcccagataccaccggagaagttgtattgacacagtctccagccaccctgtctttgtctccaggggggagagccaccctctcctgcagggccagtcagagtgttggcaacctcttagcctggtaccaacaaaaacctggccaggctcccaggctcctcatctatgatgcatccacgagggccactggcatcccagccaggttcagtggcagtgggtctgagacagacttcactctcaccatcagtggcctcgagcctgaagattttgcagtttattactgtcagcagcgtagccactggctctctttcggcggagggaccaaggttgagatcaaacgaactgtggctgcaccatctgtcttcatcttcccg

SEQ ID NO: 598182 - DNA, 480 bp, Homo sapiens; identical to SEQ ID NO: 535291
  misc_feature: HIJSMM301BKWD8.22.59.F04.1.454.light.4.raw

SEQ ID NO: 598183 - DNA, 510 bp, Homo sapiens; identical to SEQ ID NO: 536088
  misc_feature: HIJSMM301APWFU.15.34.D01.1.454.light.4.raw

SEQ ID NO: 598184 - DNA, 477 bp, Homo sapiens
  misc_feature: HIJSMM301DATFI.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggcggagggaccaaggtggaga

SEQ ID NO: 598185 - DNA, 495 bp, Homo sapiens
  misc_feature: HIJSMM301DA293.4.6.A06.1.454.light.4.raw
agcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtctggggcccccgggcagagggtcatcctctcttgttctggaggcagctccaacatcggaggacatcctgtgagctggtaccaacacctcccaggaacggcccccaaactcctcatctatacagattctaagaggcccgcaggggtcccagatcgattctctggctccaggtctggcacctcagcctccctgtccatcagtggactccggtctgaggatgaggctgactactattgttcaggatgggattacagcctacatgctcggctggttcggcggagggaccaaactgaccgtcttaggtcagcccaaggct

SEQ ID NO: 598186 - DNA, 505 bp, Homo sapiens
  misc_feature: HIJSMM301DMG6F.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaaccgtcctaggtcacgcccaaggcctgccccctc

SEQ ID NO: 598187 - DNA, 498 bp, Homo sapiens
  misc_feature: HIJSMM301ECTV8.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacatttttggccaggggaccaagctggagatcaaacgaactagtggctgcaccatctgtt

SEQ ID NO: 598188 - DNA, 494 bp, Homo sapiens; identical to SEQ ID NO: 535828
  misc_feature: HIJSMM301BA6AT.3.36.D03.1.454.light.4.raw

SEQ ID NO: 598189 - DNA, 484 bp, Homo sapiens; identical to SEQ ID NO: 535400
  misc_feature: HIJSMM301AQRM1.46.26.C04.1.454.light.4.raw

SEQ ID NO: 598190 - DNA, 513 bp, Homo sapiens; identical to SEQ ID NO: 535244
  misc_feature: HIJSMM301DVSFR.17.33.C11.1.454.light.4.raw

SEQ ID NO: 598191 - DNA, 488 bp, Homo sapiens; identical to SEQ ID NO: 535861
  misc_feature: HIJSMM301DOC47.14.55.E11.1.454.light.4.raw

SEQ ID NO: 598192 - DNA, 500 bp, Homo sapiens
  misc_feature: HIJSMM301DQ1M6.10.68.G02.1.454.light.4.raw
catagtagtgcacgaccggtgctcgattagtcgatagtgaagggaaaggggggtgtgggctcaggaggcagagctctgggaatctcaccatggcctggacccctctcctgctccccctcctcactttctgcacagtctctgaggcctcgtatgaactgacacagccaccctcggtgtcagtgtccccaggacagactgccaggatcagctgctctggagatgcattgccaacaaaatatgcttattggtacgagcaaaagccaggccaggcccctgtcttgttgatatatgaggacaccaagcgaccctccggaatttctgagagattctccggctccagctcagggacagtggcctccttgactatcagtgggcccagggggtcgatgaggctgactactactgtttctcgactgacttcactggtaaacgttggctgttcggcggagggaccaagctgaccgtcctgcgtcagcccaaggctgccccctcggtcactc

SEQ ID NO: 598193 - DNA, 448 bp, Homo sapiens; identical to SEQ ID NO: 540364
  misc_feature: HIJSMM301CN4R0.18.9.A09.1.454.light.4.raw

SEQ ID NO: 598194 - DNA, 490 bp, Homo sapiens; identical to SEQ ID NO: 535234
  misc_feature: HIJSMM301EKZO9.17.21.B10.1.454.light.4.raw

SEQ ID NO: 598195 - DNA, 513 bp, Homo sapiens
  misc_feature: HIJSMM301A5T9N.22.36.D03.1.454.light.4.raw
acatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaacccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaattaggcgccactctcgtggttttcggcggaggcaccgaagtgaccgtctcggtcagcccaaggctgccccctcggtcactc

SEQ ID NO: 598196 - DNA, 496 bp, Homo sapiens; identical to SEQ ID NO: 535109
  misc_feature: HIJSMM301A6GD4.16.78.H01.1.454.light.4.raw

SEQ ID NO: 598197 - DNA, 504 bp, Homo sapiens
  misc_feature: HIJSMM301C99RH.22.27.C05.1.454.light.4.raw
acatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagacgctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctcctcagacgttcggccaagggaccgaaggtaggaaagtacaaacgaacctgtggctgcacc

SEQ ID NO: 598198 - DNA, 477 bp, Homo sapiens
  misc_feature: HIJSMM301E1HPY.48.2.A02.1.454.light.4.raw
agtatacatacacgaccggtgctcgatttagactcatctacagggggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggccaggggaccgaaagtggatgtcaaccgaactgtggctgcacca

SEQ ID NO: 598199 - DNA, 497 bp, Homo sapiens; identical to SEQ ID NO: 535740
  misc_feature: HIJSMM301EC825.3.71.G05.1.454.light.4.raw

SEQ ID NO: 598200 - DNA, 490 bp, Homo sapiens
  misc_feature: HIJSMM301E3YK3.46.67.G01.1.454.light.4.raw
actagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagattttgcaacttattactgtcaacagaattacaatgttttcggccaagggacacgactacaaattaaacgaactgtggctgcaccatctgtcttcatcttcccgcat

SEQ ID NO: 598201 - DNA, 521 bp, Homo sapiens; identical to SEQ ID NO: 536990
  misc_feature: HIJSMM301DFV78.27.23.C01.1.454.light.4.raw
  modified_base (517)..(517): a, c, t, g, unknown or other

SEQ ID NO: 598202 - DNA, 500 bp, Homo sapiens
  misc_feature: HIJSMM301AJFGD.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggcctcccagataccactggagaaatagtgatgacgcagtctccagccaccctgtctgtgtctccgaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagtattttgcggtttattactgtcagcagtataataactggcctccacggtacacttttggccaggggaccaagctggagatcaaacgaactgtggctgcaccatctgtt

SEQ ID NO: 598203 - DNA, 492 bp, Homo sapiens
  misc_feature: HIJSMM301DANYJ.48.78.H01.1.454.light.4.raw
agtatacatacacgaccggtgctcgatttagtgtgagtagtttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgccccctc

SEQ ID NO: 598204 - DNA, 500 bp, Homo sapiens
  misc_feature: HIJSMM301DCMMF.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaatttcggtcaggggaccaagttgaacatcaatcgaactgtggctgcaccatctgtcttcatcttccccg

SEQ ID NO: 598205 - DNA, 496 bp, Homo sapiens
  misc_feature: HIJSMM301BC9UE.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccataagcagcctgcaggctgaagatgtggcagtttattattgtcaacaatattattatacttcgtggacgttggccaaggaccaaggtggatagtcagacgaactgtggctgca

SEQ ID NO: 598206 - DNA, 502 bp, Homo sapiens
  misc_feature: HIJSMM301BSHWS.15.83.H06.1.454.light.4.raw
tctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgcaaagtggggccccatcaaggttcagtggcagtggctctgggacagatttcactctcaccatcagcagtctccaacctgaagattttgcaacttactactgtacaacagagtttcagtagtccccggacgttcggtccaagggaccgaaggtggacgatacaaacgaaactagtaggcgtgcgaccatctgtcgtt

SEQ ID NO: 598207 - DNA, 479 bp, Homo sapiens
  misc_feature: HIJSMM301DDALB.11.11.A11.1.454.light.4.raw
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaacctgcaggctgaagatgtggcagtttattactgtcagcagtattgtgaagctcccgctcactttcggcggaggggaccgcggtggagatcagacgaactgtgctgcaccatctgtctt

SEQ ID NO: 598208 - DNA, 489 bp, Homo sapiens; identical to SEQ ID NO: 535139
  misc_feature: HIJSMM301B3TXU.14.55.E11.1.454.light.4.raw

SEQ ID NO: 598209 - DNA, 495 bp, Homo sapiens; identical to SEQ ID NO: 543094
  misc_feature: HIJSMM301DQAPG.22.57.F02.1.454.light.4.raw

SEQ ID NO: 598210 - DNA, 493 bp, Homo sapiens
  misc_feature: HIJSMM301CS5YS.10.79.H02.1.454.light.4.raw
catagtagtgcacgaccggtgctcgatttagtgtcacacgaagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggcctaggggaccaagctggagatcaaacgaactgtggctgcacatctgtctt

SEQ ID NO: 598211 - DNA, 512 bp, Homo sapiens; identical to SEQ ID NO: 542433
  misc_feature: HIJSMM301BD80V.11.57.F02.1.454.light.4.raw

SEQ ID NO: 598212 - DNA, 500 bp, Homo sapiens
  misc_feature: HIJSMM301D80T3.43.34.D01.1.454.light.4.raw
tgtgagtagtcacgaccggtgctcgatttagatcgtctgtgttgggtttgggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaaccccta

SEQ ID NO: 598213 - DNA, 480 bp, Homo sapiens
  misc_feature: HIJSMM301C2ASX.46.26.C04.1.454.light.4.raw
  modified_base (441)..(441): a, c, t, g, unknown or other
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctattgggttctaatcgggctccggggtccctgacaggttcagtggcagtggatcaggcacagattttacactgaaaatcagcagagtgaggctgaggatgtgggctctattattgcatgcaagctctacaagtcccgntcactttcggcggagggaccaaggtggagatcaaacgaa

SEQ ID NO: 598214 - DNA, 511 bp, Homo sapiens
  misc_feature: HIJSMM301ARZKT.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgtcgtccgacggacgacacgtagaatagagacgaacgtagtggcgtgcgaccactactcgtcttctactcttcccgt

SEQ ID NO: 598215 - DNA, 492 bp, Homo sapiens
  misc_feature: HIJSMM301CXKRE.11.12.B01.1.454.light.4.raw
cgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaaataccaggcggccctctggggtccctgagcgattctccggctccggctctgggaacacagtcactctgaccatcagcgggacccaggctattgatgaggctgtctacttctgtcaggcgtgggacaacagcgtggtgttcggcggagggaccagtctgaccgtcttaggtcagcccaaggcctgccccctcggtcacttc

SEQ ID NO: 598216 - DNA, 490 bp, Homo sapiens
  misc_feature: HIJSMM301CMQTA.14.53.E09.1.454.light.4.raw
cgtctagtaccacgaccggtgctcgatttagagagagtgtgttgggtttgggggggagcctagctgtgctgtgggtccaggaggcagaactctgggtgtctcaccatggcctggatccctctacttctcctcctcctcactctctgcacaggctctcaggcctcctatgagctgacacagcccaccctcggtgtcagtgtccccaggacagacggccaggatcacctgctctggagatttgttgacaaagcagtatgctttttggtaccagcagaagccaggccaggcccctctcttgattatatataaggacactgagaggccctcagggatccctgagcgattctctggctccagctcgagggacaacactcaccttgaccatcagtgcagtccaggcagaagacgaggctgactattattgtcaatcagcagtcagcacttaattcttatcgggtgttcggcggagggaccaagctcgaccgtctac

SEQ ID NO: 598217 - DNA, 512 bp, Homo sapiens; identical to SEQ ID NO: 541300
  misc_feature: HIJSMM301BTREG.17.33.C11.1.454.light.4.raw

SEQ ID NO: 598218 - DNA, 518 bp, Homo sapiens
  misc_feature: HIJSMM301AQ7UV.41.19.B08.1.454.light.4.raw
tctatactatcacgaccggtgctcgatttagtgagtcagtaagggcacgaccggtgctcgatttagtgagtcagtaagggggctggggtctcaggaggcagcgctctcgggacgtctccaccatggcctgggctctgctatccctcaccctcctcactcagggcacaggttcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagccc

SEQ ID NO: 598219 - DNA, 494 bp, Homo sapiens; identical to SEQ ID NO: 562650
  misc_feature: HIJSMM301DQH9G.3.33.C11.1.454.light.4.raw

SEQ ID NO: 598220 - DNA, 477 bp, Homo sapiens; identical to SEQ ID NO: 554966
  misc_feature: HIJSMM301EWA0N.12.1.A01.1.454.light.4.raw

SEQ ID NO: 598221 - DNA, 441 bp, Homo sapiens; identical to SEQ ID NO: 550529
  misc_feature: HIJSMM301EZT4P.41.9.A09.1.454.light.4.raw

SEQ ID NO: 598222 - DNA, 509 bp, Homo sapiens; identical to SEQ ID NO: 541829
  misc_feature: HIJSMM301DIHZT.17.28.C06.1.454.light.4.raw

SEQ ID NO: 598223 - DNA, 468 bp, Homo sapiens
  misc_feature: HIJSMM301AOF4R.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcacttcggcctgggactgaatgcatatgaagagaactgtgg

SEQ ID NO: 598224 - DNA, 506 bp, Homo sapiens
  misc_feature: HIJSMM301CFFMX.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactccccgtggtattcggcggaggggaccaaggtgaccgtcctaggtcagcccaaggctgccccccg

SEQ ID NO: 598225 - DNA, 503 bp, Homo sapiens
  misc_feature: HIJSMM301B6J5N.43.69.G03.1.454.light.4.raw
tgtgagtagtcacgaccggtgctcgatttagtcgctgcgtaaaggagaaaggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtggttcggcgggggaccaagctgaccgtcctaggtcagcccaaggctgccccctcggtctac

SEQ ID NO: 598226 - DNA, 494 bp, Homo sapiens; identical to SEQ ID NO: 535276
  misc_feature: HIJSMM301BTMO9.16.6.A06.1.454.light.4.raw

SEQ ID NO: 598227 - DNA, 498 bp, Homo sapiens
  misc_feature: HIJSMM301CJOF0.17.43.D10.1.454.light.4.raw
cgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacgagccaccctctcctgcagggccagtcagagtgtgagcagcaacttagcctggtatcagcagaaacctggccaggctcccaggctcctcatctatggtgcttccaccagggccgctggtgtcccagccagattcaggggcagtgggtctgggacagagttcactctcaccatcagcagcctgcagtctgaagattttgcagtttattactgtcagcactataataactggccccggggggacgttcggccaagggaccgaaggtggagatcaaacgaactgtggctgcaccatctgtcttcattccc

SEQ ID NO: 598228 - DNA, 494 bp, Homo sapiens; identical to SEQ ID NO: 534992
  misc_feature: HIJSMM301BUM0R.9.1.A01.1.454.light.4.raw

SEQ ID NO: 598229 - DNA, 486 bp, Homo sapiens; identical to SEQ ID NO: 535385
  misc_feature: HIJSMM301B4YBC.19.71.G05.1.454.light.4.raw

SEQ ID NO: 598230 - DNA, 497 bp, Homo sapiens; identical to SEQ ID NO: 553226
  misc_feature: HIJSMM301D6A0P.16.78.H01.1.454.light.4.raw

SEQ ID NO: 598231 - DNA, 507 bp, Homo sapiens
  misc_feature: HIJSMM301EFFCZ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgccgaagggaccaaggtaggaaatacaaacgaactagtggtctgcaccatctgtcttctatcttccccg

SEQ ID NO: 598232 - DNA, 489 bp, Homo sapiens
  misc_feature: HIJSMM301DXE2W.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcacgcccaaggctcgccccctcggtcactctcgttcccaccctccctcgctacgtaga

SEQ ID NO: 598233 - DNA, 460 bp, Homo sapiens; identical to SEQ ID NO: 536053
  misc_feature: HIJSMM301DMKX6.22.28.C06.1.454.light.4.raw

SEQ ID NO: 598234 - DNA, 494 bp, Homo sapiens
  misc_feature: HIJSMM301BYCO3.40.81.H04.1.454.light.4.raw
tctagcgactcacgaccggtgctcgatttagtagtgtagattcgcgggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagattttacactgaaaatcagcagggtggaggcagaagatgttgggatttattactgcatgcaacctctacaaactgtgtggacggtcggccaagggaccaaggtggaaatcaagcgaactgtggctgcaccta

SEQ ID NO: 598235 - DNA, 503 bp, Homo sapiens; identical to SEQ ID NO: 582113
  misc_feature: HIJSMM301CSC43.48.71.G05.1.454.light.4.raw

SEQ ID NO: 598236 - DNA, 487 bp, Homo sapiens; identical to SEQ ID NO: 541861
  misc_feature: HIJSMM301B34TM.12.31.C09.1.454.light.4.raw

SEQ ID NO: 598237 - DNA, 497 bp, Homo sapiens
  misc_feature: HIJSMM301ANX1K.16.10.A10.1.454.light.4.raw
tgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagaggccctccagggatccctgggcgattctctggctccagctcagggacgacagtcacgttgaccatcggtggagtccaggcagaagacgagggtgactattactgtcagtctgcaaacaccactgcagcggtgttcggcggagggaccaagctgaccgtcctgcgtcagcccaaggctgccccctcggtcactctgttcccta

SEQ ID NO: 598238 - DNA, 514 bp, Homo sapiens; identical to SEQ ID NO: 538885
  misc_feature: HIJSMM301B93DC.14.19.B08.1.454.light.4.raw

SEQ ID NO: 598239 - DNA, 489 bp, Homo sapiens; identical to SEQ ID NO: 535139
  misc_feature: HIJSMM301E1O3J.14.55.E11.1.454.light.4.raw

SEQ ID NO: 598240 - DNA, 471 bp, Homo sapiens
  misc_feature: HIJSMM301ETX30.51.1.A01.1.454.light.4.raw
cgatcgtatacacgaccggtgctcgatttagacgtctcatcagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggaaagcccctaagctcctgatcctcgatgcatccaatttggaaacaggggtcccatcaaggttcagtgcaagtggctctgggacagatttcactttcaccatcagcagactgcagcctgaagatattgcaacatattactgtcaacagtatgataatctcccgctcactttcggcggtagggaccaagggtggggatccaaacgaactgtgg

SEQ ID NO: 598241 - DNA, 509 bp, Homo sapiens; identical to SEQ ID NO: 545244
  misc_feature: HIJSMM301EULL3.51.38.D05.1.454.light.4.raw

SEQ ID NO: 598242 - DNA, 507 bp, Homo sapiens; identical to SEQ ID NO: 585143
  misc_feature: HIJSMM301AIWSK.22.28.C06.1.454.light.4.raw

SEQ ID NO: 598243 - DNA, 484 bp, Homo sapiens; identical to SEQ ID NO: 547458
  misc_feature: HIJSMM301BOPAL.15.1.A01.1.454.light.4.raw

SEQ ID NO: 598244 - DNA, 492 bp, Homo sapiens
  misc_feature: HIJSMM301A0MRF.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttaacacttttggccaggggaccaagctggagatcaaacgaactgt

SEQ ID NO: 598245 - DNA, 482 bp, Homo sapiens; identical to SEQ ID NO: 537205
  misc_feature: HIJSMM301CAF3C.5.39.D06.1.454.light.4.raw

SEQ ID NO: 598246 - DNA, 480 bp, Homo sapiens; identical to SEQ ID NO: 535442
  misc_feature: HIJSMM301DB73K.41.17.B06.1.454.light.4.raw

SEQ ID NO: 598247 - DNA, 474 bp, Homo sapiens; identical to SEQ ID NO: 535264
  misc_feature: HIJSMM301DCSIX.13.76.G10.1.454.light.4.raw

SEQ ID NO: 598248 - DNA, 496 bp, Homo sapiens; identical to SEQ ID NO: 535541
  misc_feature: HIJSMM301CTQVQ.3.33.C11.1.454.light.4.raw

SEQ ID NO: 598249 - DNA, 520 bp, Homo sapiens; identical to SEQ ID NO: 585691
  misc_feature: HIJSMM301CJG4W.12.71.G05.1.454.light.4.raw

SEQ ID NO: 598250 - DNA, 512 bp, Homo sapiens
  misc_feature: HIJSMM301AUK3X.52.41.D08.1.454.light.4.raw
cgcagtacgacacgaccggtgctcgatttagtcacgcgagaaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataattctgtctcctggtaccaacaataccccggcaaagtccccaaactcatgatctttgaggtcaatgatcggcccgcaggggtttctcatcgcttctccggctccaagtctggcagcacggcctccctgaccatctctgggctccaggctgaggacgaggctgattattactgcagctcatatacaaacagaaacacttgggtgttcggcggcgggaccagactgaccgtcctacgtcagccaaggctgccccctcggtcactctgtt

SEQ ID NO: 598251 - DNA, 494 bp, Homo sapiens; identical to SEQ ID NO: 539784
  misc_feature: HIJSMM301DXFS2.22.57.F02.1.454.light.4.raw

SEQ ID NO: 598252 - DNA, 513 bp, Homo sapiens; identical to SEQ ID NO: 565259
  misc_feature: HIJSMM301CTKDH.17.33.C11.1.454.light.4.raw

SEQ ID NO: 598253 - DNA, 513 bp, Homo sapiens
  misc_feature: HIJSMM301DR1OF.8.1.A01.1.454.light.4.raw
ctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgccaaagaaatatgcttattggtaccagcagaagtcaggccaggcccctgtcctggtcatttatgaggacaagaaacgaccctccgggatccctgacagactctctggctccagctcagggacagtggccaccttgactatcactggggcccaggtggaggatgaaggagactactattgttactctccagagaaggatggtcattcattgggtgttcgggcggagggaccaagctggaccgtcctaagtcagcccaaggctcgccccctcggtcactctcgttcccaccctccc

SEQ ID NO: 598254 - DNA, 485 bp, Homo sapiens
  misc_feature: HIJSMM301C4GUS.49.3.A03.1.454.light.4.raw
agtcgagagacacgaccggtgctcgatttagagagcgtcacaggggaggaactgctcagttaggacccagacggaaccatggaagccccagcgcagcttctcttcctcctgctactctggctcccagataccactggagaaatagtgatgacgcagtctccagccactttgtctgtgtctccaggggagagagccactctctcctgcaggaccagtcagagtgttaataacaagttagcctggtaccagcagagacctggccaggctcccaggctcctcatctatgatgtgtctaccagggccactggtatcccagccaggttcagtggcagtgggtctggggcggagttcactctcaccatcagcagcctgcagtctgaagattttgcagtttattactgtcagcactctaatgactggcccctgtacacttttggcccggggaccaaggtggagatcaaacgaactgtggctgcaccatctgt

SEQ ID NO: 598255 - DNA, 503 bp, Homo sapiens; identical to SEQ ID NO: 574363
  misc_feature: HIJSMM301AS5IF.2.35.D02.1.454.light.4.raw

SEQ ID NO: 598256 - DNA, 495 bp, Homo sapiens
  misc_feature: HIJSMM301CAIK8.13.10.A10.1.454.light.4.raw
tcacgtactacacgaccggtgctcgatttagcgtcgatctcaggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttgggaacaaagctgcccttatcatcacgggggcccaggcagaagatgaatctgattattactgtgttctttatatgggtagtgccatttctgctgtgttcggaggaggcacccggctgaccgtcctggtcagcccaaggctgcccc

SEQ ID NO: 598257 - DNA, 509 bp, Homo sapiens; identical to SEQ ID NO: 543772
  misc_feature: HIJSMM301BM6Y3.2.21.B10.1.454.light.4.raw

SEQ ID NO: 598258 - DNA, 519 bp, Homo sapiens
  misc_feature: HIJSMM301CJG0V.41.14.B03.1.454.light.4.raw
tctatactatcacgaccggtgctcgatttagtgtgagtagttccgcgggcacgaccggtgctcgatttagcagtactgcgttgggtttgggggctggggtctcaggaggcagcgctctcaggacgtcaccaccatggcctgggctctgctcctcctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattactactgcttctcatatgcagatactaagtcctgggtgttcggcggagggaccaagctgaccgtccg

SEQ ID NO: 598259 - DNA, 501 bp, Homo sapiens
  misc_feature: HIJSMM301DRNOO.18.78.H01.1.454.light.4.raw
tacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtccaggtcagccaaggcaacccactgtca

SEQ ID NO: 598260 - DNA, 509 bp, Homo sapiens
  misc_feature: HIJSMM301CG1N0.22.28.C06.1.454.light.4.raw
acatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctggaccgtcctaggtcagcccaaggctg

SEQ ID NO: 598261 - DNA, 499 bp, Homo sapiens
  misc_feature: HIJSMM301AEQHY.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtacttactttacctacaagtgatcaccttcggtaccgaaggacacgacgtggagtataaacgaactgtggctgcaccatctgtctt

SEQ ID NO: 598262 - DNA, 514 bp, Homo sapiens
  misc_feature: HIJSMM301BP3KK.17.37.D04.1.454.light.4.raw
cgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctgtgggggaaacaatgttggaagtaaactgtgcactggtaccagcagaagccaggccaggcccctgtgctggtcgtctatgatgataccgaccggccctcagggatccctgagcgattctctggctccaactctgggaacacggccaccctgaccatcggcagggtcgaaggccggggatgaggccgactattattgtcaggtgtggatagtagtagtgatcatgtggtattcggcggagggaccaagctgaccgtccttggtcagcccaaggctcgccccctcggtcactctgttcccaccct

SEQ ID NO: 598263 - DNA, 491 bp, Homo sapiens; identical to SEQ ID NO: 536211
  misc_feature: HIJSMM301ADO1Y.16.53.E09.1.454.light.4.raw

SEQ ID NO: 598264 - DNA, 486 bp, Homo sapiens
  misc_feature: HIJSMM301CU35N.48.38.D05.1.454.light.4.raw
agtatacatacacgaccggtgctcgatttagtatctgatagttgggtttgggggctgtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtctaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaagg

SEQ ID NO: 598265 - DNA, 493 bp, Homo sapiens; identical to SEQ ID NO: 548342
  misc_feature: HIJSMM301BN7QV.27.78.H01.1.454.light.4.raw

SEQ ID NO: 598266 - DNA, 504 bp, Homo sapiens; identical to SEQ ID NO: 537401
  misc_feature: HIJSMM301C81U4.51.23.C01.1.454.light.4.raw

SEQ ID NO: 598267 - DNA, 494 bp, Homo sapiens; identical to SEQ ID NO: 542031
  misc_feature: HIJSMM301BU4BC.12.23.C01.1.454.light.4.raw

SEQ ID NO: 598268 - DNA, 495 bp, Homo sapiens
  misc_feature: HIJSMM301EQCGR.10.33.C11.1.454.light.4.raw
catagtagtgcacgaccggtgctcgatttagagtgagctcgttgggtttggggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggtaccaaggtggagttcaaacgaactgtggctgcacatctgtcttcatt

SEQ ID NO: 598269 - DNA, 495 bp, Homo sapiens
  misc_feature: HIJSMM301EUP8P.40.54.E10.1.454.light.4.raw
tctagcgactcacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccagcatcacctgctctggagattcattgtcaaagcaatatgcttattggtaccagcagaaaccaggccaggcccctgtggtggtgctatataaagacactgagaggccctcagggacccctgagcgattctctggctccaggtcagggacaacagtcacgttgaccatcagtggagtccaggcagaagacgaggctgactattactgtcaatcagcagacagcagtggtacttttcgggttttcgcggaggaccaagctgaccgtcctaggtcagcccaaggctgccccctcggt

SEQ ID NO: 598270 - DNA, 495 bp, Homo sapiens; identical to SEQ ID NO: 573086
  misc_feature: HIJSMM301AJ8NC.48.63.F08.1.454.light.4.raw

SEQ ID NO: 598271 - DNA, 479 bp, Homo sapiens
  misc_feature: HIJSMM301C85XF.21.25.C03.1.454.light.4.raw
  modified_base (463)..(463): a, c, t, g, unknown or other
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccgggctgacgatgaggctgattattattgccagtcctatgacaacacctgcgtggttttggntgttgcggcgggcaag

SEQ ID NO: 598272 - DNA, 509 bp, Homo sapiens; identical to SEQ ID NO: 544573
  misc_feature: HIJSMM301EW13Q.10.88.H11.1.454.light.4.raw

SEQ ID NO: 598273 - DNA, 514 bp, Homo sapiens; identical to SEQ ID NO: 541418
  misc_feature: HIJSMM301C9Z9S.17.33.C11.1.454.light.4.raw

SEQ ID NO: 598274 - DNA, 493 bp, Homo sapiens; identical to SEQ ID NO: 535047
  misc_feature: HIJSMM301AKEKK.16.53.E09.1.454.light.4.raw

SEQ ID NO: 598275 - DNA, 503 bp, Homo sapiens
  misc_feature: HIJSMM301BFMFA.48.53.E09.1.454.light.4.raw
agtatacatacacgaccggtgctcgatttagagagagtgtgttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatctccccg

SEQ ID NO: 598276 - DNA, 484 bp, Homo sapiens; identical to SEQ ID NO: 535240
  misc_feature: HIJSMM301A1C1M.47.60.F05.1.454.light.4.raw

SEQ ID NO: 598277 - DNA, 503 bp, Homo sapiens; identical to SEQ ID NO: 538884
  misc_feature: HIJSMM301AHK2J.27.78.H01.1.454.light.4.raw

SEQ ID NO: 598278 - DNA, 479 bp, Homo sapiens; identical to SEQ ID NO: 535118
  misc_feature: HIJSMM301EBEG1.13.59.F04.1.454.light.4.raw

SEQ ID NO: 598279 - DNA, 511 bp, Homo sapiens
  misc_feature: HIJSMM301EIP8M.4.57.F02.1.454.light.4.raw
agcactgtagcacgaccggtgctcgatttagctcgatatagttggggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaaccccactgtcactctgttcccgt

SEQ ID NO: 598280 - DNA, 502 bp, Homo sapiens
  misc_feature: HIJSMM301BBGFQ.43.62.F07.1.454.light.4.raw
tgtgagtagtcacgaccggtgctcgatttagtagtcgcataaagggaaagggggagtcagtctcagtcaggacacagcatggacatgagggtccccgctcagctcctggggctcctgctactctggctccgaggtgccagatgtgacatccagttgacgcagtctccatcctccctgtctgcatctgtgggagacagactcaccatcacttgccgggcaagtcagaccattaggacctatttaaattggtatcaggagaacccagggaaagccctaagctcctgatctatgctacttccactttgcaaagtggggtcccatctaggttcagtggcagtggatcggggacacatttcactctcaccatcagtagtctgcaacctgaagattatgcaacttacttctgtcaacagagtgacagaaacccgtggacgttcggccaagggaccaaggtggaaagcaaacgaactagtggctgcaccatctgtcttcatcttccccg

SEQ ID NO: 598281 - DNA, 514 bp, Homo sapiens
  misc_feature: HIJSMM301DMVFA.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagatttttgcaacttactactgtcaacagagtttcagtgtcccccggacgtcgtccgagggaccgacacgtagaaatagagacgaactacgtggcgtcgcaccactcttgtcttcctactcttcccgt

SEQ ID NO: 598282 - DNA, 504 bp, Homo sapiens
  misc_feature: HIJSMM301CIHUK.10.27.C05.1.454.light.4.raw
catagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgcctctttcaaggttttcggcggagggaccaggctgaccgtctaagtcagcccaaggctgcccctcggt

SEQ ID NO: 598283 - DNA, 488 bp, Homo sapiens; identical to SEQ ID NO: 537260
  misc_feature: HIJSMM301EII8X.47.70.G04.1.454.light.4.raw

SEQ ID NO: 598284 - DNA, 506 bp, Homo sapiens; identical to SEQ ID NO: 583265
  misc_feature: HIJSMM301B0U58.8.42.D09.1.454.light.4.raw

SEQ ID NO: 598285 - DNA, 504 bp, Homo sapiens
  misc_feature: HIJSMM301DCRCR.27.78.H01.1.454.light.4.raw
agcgtcgtctcacgaccggtgctcgatttagtgtgagtagtttgggtttgggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacg

SEQ ID NO: 598286 - DNA, 492 bp, Homo sapiens
  misc_feature: HIJSMM301C9WWN.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagtggcctgcagtctgaagattttgcagtttattactgtcagcagtataatgactgggttttattcactttcggccctgggaccaaagtggatttcagacgaactgtggctgcaccatctgtcttcta

SEQ ID NO: 598287 - DNA, 490 bp, Homo sapiens
  misc_feature: HIJSMM301EWOKA.48.43.D10.1.454.light.4.raw
agtatacatacacgaccggtgctcgatttagactagcagtaagggggctggtcacacttcttgcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtcaccctcacttgccgggcaagtcaggccatttccaattctttagcctggtatcagcagaaaccaggacaaactcctacactcctgatctatgatgcgtccagtttagagagtggggccccatcgaggttcagcggcagtggatcagggacagagttcactctcaccatcagcagcctgcagcctgaagattttgcaacttattactgtcaacactttaacaattaccctcataagccgttcggccaagggacccaggtggaaaccaagacgaactgt

SEQ ID NO: 598288 - DNA, 492 bp, Homo sapiens; identical to SEQ ID NO: 537395
  misc_feature: HIJSMM301BF7NC.16.73.G07.1.454.light.4.raw

SEQ ID NO: 598289 - DNA, 500 bp, Homo sapiens; identical to SEQ ID NO: 594850
  misc_feature: HIJSMM301EN57S.15.1.A01.1.454.light.4.raw

SEQ ID NO: 598290 - DNA, 505 bp, Homo sapiens
  misc_feature: HIJSMM301EVT6E.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcgggcggaggggaccaaactgaccgtcctaggtcagccccaa

SEQ ID NO: 598291 - DNA, 472 bp, Homo sapiens
  misc_feature: HIJSMM301ERVPG.18.76.G10.1.454.light.4.raw
tacgagtatgcacgaccggtgctcgatttagtcactcatacagggggcgaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacttttggcggggggaccaaggtggacatcaaacgaa

SEQ ID NO: 598292 - DNA, 515 bp, Homo sapiens
  misc_feature: HIJSMM301BVO12.5.58.F03.1.454.light.4.raw
atcagacacgcacgaccggtgctcgatttagtctgatcgagaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtcagcccaacggccaaccccactcgtcactcttccg

SEQ ID NO: 598293 - DNA, 509 bp, Homo sapiens; identical to SEQ ID NO: 553073
  misc_feature: HIJSMM301AWJJM.16.1.A01.1.454.light.4.raw

SEQ ID NO: 598294 - DNA, 499 bp, Homo sapiens
  misc_feature: HIJSMM301BYPU0.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtggaaatcaaacgaactgtggctgccaccta

SEQ ID NO: 598295 - DNA, 512 bp, Homo sapiens
  misc_feature: HIJSMM301A2M95.16.66.F11.1.454.light.4.raw
tgtactactccacgaccggtgctcgatttagtcacgcgagaagggtgagaagtagtggagcccaggccatagtggggatgctccaggctctgcttcctgagctaccccactatggcctgggctccactacttctcacctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaagctg

SEQ ID NO: 598296 - DNA, 520 bp, Homo sapiens
  misc_feature: HIJSMM301A1R0U.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgccaatggttgcaccgcaaagcggggacccagaccctggagcctcagttggaagcagccgatccagcctgcggagcctgtggggcaggtcagcccaaggccaaccccactcgtcactcttccg

SEQ ID NO: 598297 - DNA, 514 bp, Homo sapiens
  misc_feature: HIJSMM301AKEFU.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctacttactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtctaggtcagcccaaggctgccccctcggtcactctgtttcccaccctcctcgagtagtaca

SEQ ID NO: 598298 - DNA, 504 bp, Homo sapiens
  misc_feature: HIJSMM301D9AH8.10.12.B01.1.454.light.4.raw
catagtagtgcacgaccggtgctcgatttagtagtgtagattccgcgggggtgggtccaggaggcagaactctgggtgtctcaccatggcctggatccctctacttctccccctcctcactctctgcacagggtccgaggcctcctatgagctgacacagccaccctcggtgtcagtgtccccaggacagacggccaggatcacctgctctggagatgctttgccgaagcaatatgcttactggtaccagcagaagccaggccaggcccctgtggaacttgtatataaggacactgagaggcccccagggatccctgagcgattctctggctccagctcagggacaacagtgacgttgaccatcagcggagcccgggcagaggacgaggctgactattactgtcaatcacaagacattactggtacttattgggtgttcggcggagggtccaagctgaccgtcctaggtcagcccaaggctgccccctggtcactctgttccca

SEQ ID NO: 598299 - DNA, 447 bp, Homo sapiens; identical to SEQ ID NO: 535020
  misc_feature: HIJSMM301A6DLA.18.9.A09.1.454.light.4.raw

SEQ ID NO: 598300 - DNA, 489 bp, Homo sapiens; identical to SEQ ID NO: 536013
  misc_feature: HIJSMM301DD6JU.26.23.C01.1.454.light.4.raw

SEQ ID NO: 598301 - DNA, 501 bp, Homo sapiens
  misc_feature: HIJSMM301CAVNY.40.69.G03.1.454.light.4.raw
tctagcgactcacgaccggtgctcgatttagtcgctgcgtaaaggagaaagggggaggaactgctcagttaggacccagacggaaccatggaagccccagcgcagcttctcttcctcctgctactctggctcccagataccgccggagaaattgtgttgacacagtctccagccaccctgtctttatctccaggggaaagagccatcctctcctgcagggccagtcagaatattgatacatacttagcctggtaccagcagaaacctggcctggctcccagggtcctcatccatgatgcctcccacagggccactggcatcccacacaggttcagtggcagtgggtctgggacagacttcagtctcaccatcagcagcctagagcctgaggattttgctaatttatttctgtcaacagcgtagcacctggccccgggtcaccttcggccaagggacacgactggacatgaaacgaactgtggctgcaccatctgtcttcta

SEQ ID NO: 598302 - DNA, 479 bp, Homo sapiens; identical to SEQ ID NO: 535118
  misc_feature: HIJSMM301BW68R.13.59.F04.1.454.light.4.raw

SEQ ID NO: 598303 - DNA, 520 bp, Homo sapiens
  misc_feature: HIJSMM301D2FZ7.49.10.A10.1.454.light.4.raw
agtcgagagacacgaccggtgctcgatttagcgtcgatctcaggggctgggcctaaggaagcagcactggtggtgcctcagccatggcctggaccgttctcctcctcggcctcctctctcactgcacagactctgtgacctcctatgttctgactcagccgccctcggcgtcagtggccccaggacagacggccacgattccctgtaggggagacgacattggagggaaagctgtgcattggtaccagcagaagccaggccaggcccctgagctggtcctccatggtgatagcgaccggccctcaggaatccctgagagattctccggctccaactctgggggagatggccaccctgaccattaccagggccgaagccgggggatgaggccgactattactgtcaggtgtgggatagtgatacggaccattgggtgttcggcggagggaccaaggtgaccgtcctaggtcagcccaaggctgccccctcggtcactctgttcccgccctcctctctctcg

SEQ ID NO: 598304 - DNA, 482 bp, Homo sapiens; identical to SEQ ID NO: 594586
  misc_feature: HIJSMM301DH86O.21.25.C03.1.454.light.4.raw

SEQ ID NO: 598305 - DNA, 491 bp, Homo sapiens; identical to SEQ ID NO: 540256
  misc_feature: HIJSMM301BU7UI.46.67.G01.1.454.light.4.raw

SEQ ID NO: 598306 - DNA, 508 bp, Homo sapiens; identical to SEQ ID NO: 582890
  misc_feature: HIJSMM301BRRT5.16.1.A01.1.454.light.4.raw

SEQ ID NO: 598307 - DNA, 511 bp, Homo sapiens; identical to SEQ ID NO: 539247
  misc_feature: HIJSMM301D14VK.15.34.D01.1.454.light.4.raw

SEQ ID NO: 598308 - DNA, 504 bp, Homo sapiens
  misc_feature: HIJSMM301DJ4O4.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtctcatcttcccgcc

SEQ ID NO: 598309 - DNA, 490 bp, Homo sapiens; identical to SEQ ID NO: 549489
  misc_feature: HIJSMM301D8T6F.10.53.E09.1.454.light.4.raw

SEQ ID NO: 598310 - DNA, 486 bp, Homo sapiens; identical to SEQ ID NO: 548935
  misc_feature: HIJSMM301B17RJ.47.38.D05.1.454.light.4.raw

SEQ ID NO: 598311 - DNA, 495 bp, Homo sapiens
  misc_feature: HIJSMM301A2VDG.22.57.F02.1.454.light.4.raw
acatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaacagcctgcagcctgatgatttggcaacttactactgccaaccgtatagtacttattcggtcaccttcggccaagggacacgactggagattaaacgaactagt

SEQ ID NO: 598312 - DNA, 494 bp, Homo sapiens; identical to SEQ ID NO: 534992
  misc_feature: HIJSMM301BNU8U.9.1.A01.1.454.light.4.raw

SEQ ID NO: 598313 - DNA, 462 bp, Homo sapiens; identical to SEQ ID NO: 541820
  misc_feature: HIJSMM301DM0IV.4.39.D06.1.454.light.4.raw

SEQ ID NO: 598314 - DNA, 521 bp, Homo sapiens; identical to SEQ ID NO: 538715
  misc_feature: HIJSMM301ESDKG.27.23.C01.1.454.light.4.raw

SEQ ID NO: 598315 - DNA, 463 bp, Homo sapiens; identical to SEQ ID NO: 535062
  misc_feature: HIJSMM301EC430.11.73.G07.1.454.light.4.raw

SEQ ID NO: 598316 - DNA, 518 bp, Homo sapiens; identical to SEQ ID NO: 544387
  misc_feature: HIJSMM301D0H16.19.80.H03.1.454.light.4.raw

SEQ ID NO: 598317 - DNA, 521 bp, Homo sapiens; identical to SEQ ID NO: 538715
  misc_feature: HIJSMM301BUUTJ.27.23.C01.1.454.light.4.raw

SEQ ID NO: 598318 - DNA, 355 bp, Homo sapiens
  misc_feature: HIJSMM301APUIJ.40.9.A09.1.454.light.4.raw
tctagcgactcacgaccggtgctcgatttagcgagacgcgcaggggcagcaagatggtgttagcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcacca

SEQ ID NO: 598319 - DNA, 504 bp, Homo sapiens
  misc_feature: HIJSMM301CG47B.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatggacaatctgagcggttgggtgttcggcggagggaccaaactgaccgtcctaggtccagcccaa

SEQ ID NO: 598320 - DNA, 498 bp, Homo sapiens
  misc_feature: HIJSMM301DKFOD.16.78.H01.1.454.light.4.raw
  modified_base (413)..(413): a, c, t, g, unknown or other
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcacgcagcctgcagtctgaagattttgcggtttattactgtcngcagtataataactggcctccacggtacacttttggccaggggaccaagctggagatcaaacgaactgtggctgcaccatctgtt

SEQ ID NO: 598321 - DNA, 500 bp, Homo sapiens; identical to SEQ ID NO: 562851
  misc_feature: HIJSMM301BJ6YD.19.78.H01.1.454.light.4.raw

SEQ ID NO: 598322 - DNA, 473 bp, Homo sapiens
  misc_feature: HIJSMM301A1U2B.49.4.A04.1.454.light.4.raw
  modified_base (456)..(456): a, c, t, g, unknown or other
agtcgagagacacgaccggtgctcgatttagagtagtgatcagggggtcagccccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggactgcagcctgaagatattgcaaacatattactgtcaacagtatgatgccttcccgctcactttcggcgggacggacgaggtggagatanaacgaactgtggctgca

SEQ ID NO: 598323 - DNA, 492 bp, Homo sapiens
  misc_feature: HIJSMM301BWZIX.49.45.E01.1.454.light.4.raw
agtcgagagacacgaccggtgctcgatttagtgagtcagtaagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccgggctcctcatctatgatgcatccaacagggccactggcatcccagccaggttcagtggcagtgggtctgtgacagacttcactctcaccatcagcagcctagagcctgaagattctgcagtttattactgtcagcagcgtagcaactggcctctcactttcggcggagggaccaaggtggagatcaaacgaactgtggctgcaccatctgtctt

SEQ ID NO: 598324 - DNA, 495 bp, Homo sapiens; identical to SEQ ID NO: 543724
  misc_feature: HIJSMM301CBUOX.15.59.F04.1.454.light.4.raw

SEQ ID NO: 598325 - DNA, 496 bp, Homo sapiens
  misc_feature: HIJSMM301A1USL.2.49.E05.1.454.light.4.raw
acgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagagcggcccccaagctcctcatctatagaaattatgaacggtcctcaggggtccctgaccgattctctggctccaagtctggcacctcagcctccctggccatcagtgggctccggtccgagatgaggctgattattactgtgttggatgggacagcagcctgagtgcttatgtcttcggaactgggaccacggtcaccgtcct

SEQ ID NO: 598326 - DNA, 515 bp, Homo sapiens; identical to SEQ ID NO: 538805
  misc_feature: HIJSMM301BT662.14.19.B08.1.454.light.4.raw

SEQ ID NO: 598327 - DNA, 496 bp, Homo sapiens; identical to SEQ ID NO: 535423
  misc_feature: HIJSMM301DV6ED.3.33.C11.1.454.light.4.raw

SEQ ID NO: 598328 - DNA, 480 bp, Homo sapiens
  misc_feature: HIJSMM301EGBS0.4.10.A10.1.454.light.4.raw
agcactgtagcacgaccggtgctcgatttagcgtcgatctcaggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttatttagcctggtatcagcaaaaaccagggaaagcccctaagctcctgatctatggtgcatccactttgcaaagtggggtcccatcaaggttcagcggcagtggatctgggacagatttcactctcaccatcagcagcctacagcctgaagattttgcaacttattactgtcaacagcttaataattacgcgctcactttcggcggagggaccgaaggtggaggatcaaacgaaactgtggctgcaccaat

SEQ ID NO: 598329 - DNA, 480 bp, Homo sapiens; identical to SEQ ID NO: 568031
  misc_feature: HIJSMM301A709Q.13.48.E04.1.454.light.4.raw

SEQ ID NO: 598330 - DNA, 505 bp, Homo sapiens; identical to SEQ ID NO: 536233
  misc_feature: HIJSMM301D3RUL.48.25.C03.1.454.light.4.raw

SEQ ID NO: 598331 - DNA, 494 bp, Homo sapiens; identical to SEQ ID NO: 534992
  misc_feature: HIJSMM301CCLUO.9.1.A01.1.454.light.4.raw

SEQ ID NO: 598332 - DNA, 478 bp, Homo sapiens
  misc_feature: HIJSMM301B3QRW.49.50.E06.1.454.light.4.raw
agtcgagagacacgaccggtgctcgatttagatctactgacaacacacaaggggagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactatttaaattggtatcagcagaaaccagggaaagcccctaaactcctgatctacgatgcatccaatttggagacaggggtcccatcaaggttcagtggaagtggatctgggacacattttactttcaccatcagcggcctgcagcctgaagattttgcaacatattactgtcaacagtatgaagatctcccactcactttcggcggagggaccaaggtggagatcagacgaactgtggctgcacc

SEQ ID NO: 598333 - DNA, 520 bp, Homo sapiens; identical to SEQ ID NO: 537173
  misc_feature: HIJSMM301C7EXQ.27.23.C01.1.454.light.4.raw

SEQ ID NO: 598334 - DNA, 505 bp, Homo sapiens; identical to SEQ ID NO: 591192
  misc_feature: HIJSMM301BNU6X.8.28.C06.1.454.light.4.raw

SEQ ID NO: 598335 - DNA, 489 bp, Homo sapiens
  misc_feature: HIJSMM301CR5YY.10.37.D04.1.454.light.4.raw
catagtagtgcacgaccggtgctcgatttagtagcatactgttgggtttggggcagagctctggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaagcctggccaggttcccagactcctcatatatgaagcctcttccagggccactggagtcccagccaggttcagcggcggtgggtctgggacagacttcactctcaccatcagcagcctgcagtctgaggaccttggagtttatactgtcagcagtatcataactggcctccgtggacgttcggccaagggaccaaggtggactcaacgaactgtgg

SEQ ID NO: 598336 - DNA, 506 bp, Homo sapiens
  misc_feature: HIJSMM301AOONO.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaggaccaaggtggaagtcaagcgaactgtggctgcaccatctgtcttcatcttcccgcc

SEQ ID NO: 598337 - DNA, 492 bp, Homo sapiens; identical to SEQ ID NO: 537395
  misc_feature: HIJSMM301B55Y3.16.73.G07.1.454.light.4.raw

SEQ ID NO: 598338 - DNA, 495 bp, Homo sapiens
  misc_feature: HIJSMM301CNZQF.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggcgggggaccaagctggagagtcaaccgaactgtggctgcaccatctgtt

SEQ ID NO: 598339 - DNA, 493 bp, Homo sapiens
  misc_feature: HIJSMM301CQWVK.51.71.G05.1.454.light.4.raw
cgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccaattggtacttatgtcttcggaactgcgaccaaggtcaccgtcctgggtcagcccaaggccaacccactgtc

SEQ ID NO: 598340 - DNA, 502 bp, Homo sapiens; identical to SEQ ID NO: 541971
  misc_feature: HIJSMM301C4FY5.4.39.D06.1.454.light.4.raw

SEQ ID NO: 598341 - DNA, 497 bp, Homo sapiens; identical to SEQ ID NO: 545672
  misc_feature: HIJSMM301BUQP9.2.49.E05.1.454.light.4.raw

SEQ ID NO: 598342 - DNA, 492 bp, Homo sapiens; identical to SEQ ID NO: 536087
  misc_feature: HIJSMM301B2CIJ.10.17.B06.1.454.light.4.raw

SEQ ID NO: 598343 - DNA, 505 bp, Homo sapiens
  misc_feature: HIJSMM301AGTHH.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagcccaaggctgccccctcggtcac

SEQ ID NO: 598344 - DNA, 476 bp, Homo sapiens; identical to SEQ ID NO: 537812
  misc_feature: HIJSMM301DRV9R.3.82.H05.1.454.light.4.raw

SEQ ID NO: 598345 - DNA, 502 bp, Homo sapiens
  misc_feature: HIJSMM301AVRXO.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccaggggacaagactggagagtcaaacgaactacgtggcgtgcaccactactgtcttt

SEQ ID NO: 598346 - DNA, 513 bp, Homo sapiens
  misc_feature: HIJSMM301A0350.5.27.C05.1.454.light.4.raw
atcagacacgcacgaccggtgctcgatttagacgcgatcgaagggtttgggagggtttgggaacctatgaacattctgtaggggccactttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaaggccggggatgaggccgactattactgtcaggtgtggaatggtgattatgattatgtcttcggaactgggaccaaggtcaccgtcctaggtcagcccaaggccaaccccactgtcactctcgttcccaccctcctccgtgtctgat

SEQ ID NO: 598347 - DNA, 472 bp, Homo sapiens
  misc_feature: HIJSMM301BX17E.3.38.D05.1.454.light.4.raw
agacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactacccctctcactttcggcggggggaccaaggtggagatcaacgaa

SEQ ID NO: 598348 - DNA, 483 bp, Homo sapiens; identical to SEQ ID NO: 535413
  misc_feature: HIJSMM301BK587.26.78.H01.1.454.light.4.raw

SEQ ID NO: 598349 - DNA, 486 bp, Homo sapiens; identical to SEQ ID NO: 535043
  misc_feature: HIJSMM301DFOM1.46.35.D02.1.454.light.4.raw

SEQ ID NO: 598350 - DNA, 486 bp, Homo sapiens; identical to SEQ ID NO: 535043
  misc_feature: HIJSMM301BR6QW.46.35.D02.1.454.light.4.raw

SEQ ID NO: 598351 - DNA, 494 bp, Homo sapiens; identical to SEQ ID NO: 534994
  misc_feature: HIJSMM301CGZRS.27.78.H01.1.454.light.4.raw

SEQ ID NO: 598352 - DNA, 513 bp, Homo sapiens
  misc_feature: HIJSMM301DA8T0.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatggggatggacaatctgagcgggttgggtgttcgggcggaggggacccaaaactggaaccgtcctagggtcagcccaac

SEQ ID NO: 598353 - DNA, 453 bp, Homo sapiens; identical to SEQ ID NO: 544521
  misc_feature: HIJSMM301C8C2T.19.86.H09.1.454.light.4.raw

SEQ ID NO: 598354 - DNA, 462 bp, Homo sapiens; identical to SEQ ID NO: 569799
  misc_feature: HIJSMM301C7LYZ.11.73.G07.1.454.light.4.raw

SEQ ID NO: 598355 - DNA, 475 bp, Homo sapiens
  misc_feature: HIJSMM301CM8BZ.7.81.H04.1.454.light.4.raw
  modified_base (467)..(467): a, c, t, g, unknown or other
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggccctggactgaagtgcatatgaagagaactgnggctgcta

SEQ ID NO: 598356 - DNA, 487 bp, Homo sapiens; identical to SEQ ID NO: 537573
  misc_feature: HIJSMM301DL2T6.3.10.A10.1.454.light.4.raw

SEQ ID NO: 598357 - DNA, 503 bp, Homo sapiens; identical to SEQ ID NO: 544729
  misc_feature: HIJSMM301CQVHI.40.53.E09.1.454.light.4.raw

SEQ ID NO: 598358 - DNA, 496 bp, Homo sapiens; identical to SEQ ID NO: 537925
  misc_feature: HIJSMM301DHKQY.22.14.B03.1.454.light.4.raw

SEQ ID NO: 598359 - DNA, 493 bp, Homo sapiens; identical to SEQ ID NO: 540127
  misc_feature: HIJSMM301B9KG5.10.17.B06.1.454.light.4.raw

SEQ ID NO: 598360 - DNA, 507 bp, Homo sapiens
  misc_feature: HIJSMM301BSHU4.8.1.A01.1.454.light.4.raw
ctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgccaaagaaatatgcttattggtaccagcagaagtcaggccaggcccctgtcctggtcatttatgaggacaagaaacgaccctccgggatccctgacagactctctggctccagctcagggacagtggccaccttgactatcactggggcccaggtggaggatgaaggagactactattgttactctccagagaaggatggtcatcattgggtgttcgggcggagggaccaagctgaccgtcctaagtcagcccaaggctgccccctcggtcactctcgttcccaccct

SEQ ID NO: 598361 - DNA, 504 bp, Homo sapiens; identical to SEQ ID NO: 573734
  misc_feature: HIJSMM301DYGYR.7.31.C09.1.454.light.4.raw

SEQ ID NO: 598362 - DNA, 493 bp, Homo sapiens; identical to SEQ ID NO: 535548
  misc_feature: HIJSMM301BSYSR.51.81.H04.1.454.light.4.raw

SEQ ID NO: 598363 - DNA, 507 bp, Homo sapiens; identical to SEQ ID NO: 591461
  misc_feature: HIJSMM301AFYKP.18.78.H01.1.454.light.4.raw

SEQ ID NO: 598364 - DNA, 503 bp, Homo sapiens
  misc_feature: HIJSMM301D553P.48.29.C07.1.454.light.4.raw
  modified_base (376)..(376): a, c, t, g, unknown or other
agtatacatacacgaccggtgctcgatttagagtgctacgaagggaaagggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttacnctcaccatcagtagcctgcaggctgaagatgtggcagtttatactgtcaacaatattattatactccgccgacgttcggccggggaccgaacgtggaaatcaaacgaactgtggctgcacatctgtt

SEQ ID NO: 598365 - DNA, 501 bp, Homo sapiens
  misc_feature: HIJSMM301BWBLC.16.38.D05.1.454.light.4.raw
tgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaagcgccaccctctcctgcagggccagtcagagtgttgccaccaatttagcctggtaccagcaaaacctggccaggctcccaggctcctcatctatggtgcatctaccagggccactgatgtcccaggccggttcagtggcaggtgggtttgggacagacttcactctcaccatcagcaccctgcagtctgaggattttgcaattttattattgtcagcagtataattactggcctccgtacacttttggccaggggaccaagctggagatcaaacgaactgtggctgcaccatctgtcttcatt

SEQ ID NO: 598366 - DNA, 509 bp, Homo sapiens; identical to SEQ ID NO: 540045
  misc_feature: HIJSMM301BD4B7.11.57.F02.1.454.light.4.raw

SEQ ID NO: 598367 - DNA, 482 bp, Homo sapiens
  misc_feature: HIJSMM301CGS0Z.13.8.A08.1.454.light.4.raw
tcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgacaaatatgtaaattggtatcaacagaagccaggtgaagcccctaagctcctgatctatactgcatccactttgtcaggcggggtcccatcaaggttccgtggcagtggatctgggacagatttcactctcaccatcaccagtctgcaacctgaagactgtgcaacttactactgccaacagtcttacggaacctcgtacacttttggccaggggaccaggctggagatcaaacgaactgtggctgcacatctgtt

SEQ ID NO: 598368 - DNA, 481 bp, Homo sapiens; identical to SEQ ID NO: 536255
  misc_feature: HIJSMM301EK7NW.10.53.E09.1.454.light.4.raw

SEQ ID NO: 598369 - DNA, 474 bp, Homo sapiens
  misc_feature: HIJSMM301ECOWX.8.67.G01.1.454.light.4.raw
ctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaattggtatcaacagagcccaggaaaagcccccaaactcctgatttatggtgcatccatttcgcaaagtggggtcccatcaaggttcagtggcagtggatctggggcagatttcaccctcaccatcagcagtctgcaacctgaagactttgcaacttactactgtcagcagtcttacagtaggccgggcacctttggccaggggacgaagctggagatcgaacgaactgtggctgcaccatctgtctcattccttcccgctatctgagacacgcgag

SEQ ID NO: 598370 - DNA, 486 bp, Homo sapiens; identical to SEQ ID NO: 536329
  misc_feature: HIJSMM301EM063.21.4.A04.1.454.light.4.raw

SEQ ID NO: 598371 - DNA, 455 bp, Homo sapiens
  misc_feature: HIJSMM301AR494.19.86.H09.1.454.light.4.raw
  modified_base (437)..(437): a, c, t, g, unknown or other
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttccccnccctcctccacgagagta

SEQ ID NO: 598372 - DNA, 494 bp, Homo sapiens; identical to SEQ ID NO: 564988
  misc_feature: HIJSMM301B0OV5.10.77.G11.1.454.light.4.raw

SEQ ID NO: 598373 - DNA, 498 bp, Homo sapiens
  misc_feature: HIJSMM301AWXZX.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgtcggtttattactgtcagcagtataataactggcctccacggtacacttttggccaggggaccaagctggagatcaaacgaactagtggctgcaccatctgt

SEQ ID NO: 598374 - DNA, 497 bp, Homo sapiens
  misc_feature: HIJSMM301DVTWD.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcaggtggcaggtgggtctgggacagagttcactctcaccatcagcagcctgcagtctgaagattttgctagtttattactgtcagcactataataactcggcctccgtactagttttcggccgacggggaccgaagcgtggagatacaaacgaactgtgg

SEQ ID NO: 598375 - DNA, 494 bp, Homo sapiens; identical to SEQ ID NO: 534994
  misc_feature: HIJSMM301A7PJ7.27.78.H01.1.454.light.4.raw

SEQ ID NO: 598376 - DNA, 517 bp, Homo sapiens; identical to SEQ ID NO: 541775
  misc_feature: HIJSMM301CBJ8V.5.27.C05.1.454.light.4.raw

SEQ ID NO: 598377 - DNA, 508 bp, Homo sapiens
  misc_feature: HIJSMM301DUEBT.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaaacagttttctcgggcgttcggccaacgggaccaaaggtaggaaagtacaaacgaaactagtggctgcaccatctgtcttcatttccgt

SEQ ID NO: 598378 - DNA, 485 bp, Homo sapiens; identical to SEQ ID NO: 535880
  misc_feature: HIJSMM301CH58N.7.75.G09.1.454.light.4.raw

SEQ ID NO: 598379 - DNA, 503 bp, Homo sapiens; identical to SEQ ID NO: 538884
  misc_feature: HIJSMM301A7UK2.27.78.H01.1.454.light.4.raw

SEQ ID NO: 598380 - DNA, 497 bp, Homo sapiens; identical to SEQ ID NO: 535664
  misc_feature: HIJSMM301C9AQ2.22.14.B03.1.454.light.4.raw

SEQ ID NO: 598381 - DNA, 529 bp, Homo sapiens
  misc_feature: HIJSMM301DXOJ7.5.27.C05.1.454.light.4.raw
  modified_base (165)..(165): a, c, t, g, unknown or other
atcagacacgcacgaccggtgctcgatttagacgcgatcgaagggtttggggagtctgggcctaaggaagcagcactggtggtgcctcagccatggcctggacctttctcctcctcggcctcctctctcactgcacaggctctgtgacctcctatgtgctgactnacccccccccgcaccctcagtgtcagtggccccaggaaagacggccgggatcacctgtgggggaaacaacattggaggtaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccgccctcctccgtcg

SEQ ID NO: 598382 - DNA, 444 bp, Homo sapiens; identical to SEQ ID NO: 549841
  misc_feature: HIJSMM301BEPVU.14.76.G10.1.454.light.4.raw

SEQ ID NO: 598383 - DNA, 473 bp, Homo sapiens; identical to SEQ ID NO: 535262
  misc_feature: HIJSMM301BUVIV.8.67.G01.1.454.light.4.raw

SEQ ID NO: 598384 - DNA, 491 bp, Homo sapiens
  misc_feature: HIJSMM301BLK9X.26.55.E11.1.454.light.4.raw
agactatactcacgaccggtgctcgatttagcactcgcacgttgggtttgggggcaggagtcagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgcaacctgaggattttgctaacttactactgtcaacagagttacaggtcccccctatacctttttggcctaggggaccaagctggagatcacaggaactgtggctgcacc

SEQ ID NO: 598385 - DNA, 475 bp, Homo sapiens
  misc_feature: HIJSMM301B1S5A.51.27.C05.1.454.light.4.raw
cgatcgtatacacgaccggtgctcgatttagacgcgatcgaagggtttggggagtcccaaccaggacacagcatggacatgagggtccctgctcagctcctggggctcctgctgctctggctctcaggtgccagatgtgtcatccagatgacccagtctccatcctccctgtctgaatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggcgggggaccaaggtggagatcaagcgaactgtggctgcacc

SEQ ID NO: 598386 - DNA, 492 bp, Homo sapiens; identical to SEQ ID NO: 571694
  misc_feature: HIJSMM301A7WI7.10.17.B06.1.454.light.4.raw

SEQ ID NO: 598387 - DNA, 488 bp, Homo sapiens
  misc_feature: HIJSMM301BRM8N.4.36.D03.1.454.light.4.raw
agcactgtagcacgaccggtgctcgatttagctgcgtcacgatctctcttggggagactcagtcaggacacagcatggacttgagggtccccgctcagctcctggggctcctgctgctctggctcccaggtgccaaatgtgacatccagatgacccagtctccttccaccctgtctgcatctgtgggggacagagtcaccatcacttgccgggccagtcagagtgttgataactggttggcctggtatcagcagaaaccagggaaagcccctaaactcctgatttatgatgcctccggtttggaaagtggggtcccatcaaggttcagcggcagtggatctgggacagaattcactctcaccatcagcagcctgcagcctgatgattttgcaacttattactgccaacagtattatagttattctttgacgtttcggccaagggaccaaggtggaaatcaaacgaactgtggctgcaccatctgtctt

SEQ ID NO: 598388 - DNA, 442 bp, Homo sapiens; identical to SEQ ID NO: 557721
  misc_feature: HIJSMM301BEH8U.11.3.A03.1.454.light.4.raw

SEQ ID NO: 598389 - DNA, 497 bp, Homo sapiens; identical to SEQ ID NO: 535286
  misc_feature: HIJSMM301A0W6O.18.59.F04.1.454.light.4.raw

SEQ ID NO: 598390 - DNA, 520 bp, Homo sapiens; identical to SEQ ID NO: 584519
  misc_feature: HIJSMM301AIBCM.27.23.C01.1.454.light.4.raw

SEQ ID NO: 598391 - DNA, 473 bp, Homo sapiens
  misc_feature: HIJSMM301D3L8H.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacttttggcggggggaccaaggtggacgatcaaacgaa

SEQ ID NO: 598392 - DNA, 519 bp, Homo sapiens
  misc_feature: HIJSMM301E0YQ3.41.25.C03.1.454.light.4.raw
tctatactatcacgaccggtgctcgatttagtagtgtagatttgggtttgggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggttttctggctccatcgacagtccctccaactccgcctcccttaccatatctgggctgaagagtgaggacgaggctgactacttctgtcagtcttatgatataaacaattatgtgataattggcggagggaccagggtgaccgtcctaggtcagcccaaggctgccccctcggtcactctgttcccgt

SEQ ID NO: 598393 - DNA, 513 bp, Homo sapiens; identical to SEQ ID NO: 548150
  misc_feature: HIJSMM301CEF26.9.74.G08.1.454.light.4.raw

SEQ ID NO: 598394 - DNA, 485 bp, Homo sapiens
  misc_feature: HIJSMM301EI6MI.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatggttgggctctattattgcatgcaagctctacaagtcccgctcactttcggcggagggaccaaggtggagatcaaacgaa

SEQ ID NO: 598395 - DNA, 485 bp, Homo sapiens; identical to SEQ ID NO: 536263
  misc_feature: HIJSMM301EL4KD.47.78.H01.1.454.light.4.raw

SEQ ID NO: 598396 - DNA, 512 bp, Homo sapiens
  misc_feature: HIJSMM301DIEXB.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggccgggggaccgaccgtcggaaagtcaaacgaactagtggctgcaccatctgtatt

SEQ ID NO: 598397 - DNA, 497 bp, Homo sapiens
  misc_feature: HIJSMM301BVPVG.9.71.G05.1.454.light.4.raw
tgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgccccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggacaggctgaccgtcctgagtcagcccaaggctgt

SEQ ID NO: 598398 - DNA, 513 bp, Homo sapiens
  misc_feature: HIJSMM301DL1FR.14.85.H08.1.454.light.4.raw
cgtctagtaccacgaccggtgctcgatttagtatcactcagtcgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatatcctgcactggaaccagcagtgacgttggtgcttataactttgtctcctggtaccaacagcacccaggcaaagcccccaaactcatgatttatgacgtcaataagcggccctcggggtccctgatcgcttctctggctccaagtctggcaacacggcctccctgaccgtctctgggctccaggctgacgatgaggctgattattactgcagctcacatgcagtcagtaacaagtttcggggttttcggcggagggaccaagctgaccgtcctaagtcagcccaaggctcgccccctcggtcactctccg

SEQ ID NO: 598399 - DNA, 503 bp, Homo sapiens
  misc_feature: HIJSMM301DAL8X.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaaagctgaccgtcctgggtcagcccaaggctgccccctggtca

SEQ ID NO: 598400 - DNA, 494 bp, Homo sapiens
  misc_feature: HIJSMM301DHUVE.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggcctaagggacacgactggagattaaacgaactgtggctgcacatctgtctt

SEQ ID NO: 598401 - DNA, 511 bp, Homo sapiens
  misc_feature: HIJSMM301CQLKT.21.22.B11.1.454.light.4.raw
  modified_base (429)..(429): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacncaacatgggatgacaatctgagcgggttgggtgttcggcggagggaccaaaactggaacccgtcctagggtccaggcccaaa

SEQ ID NO: 598402 - DNA, 444 bp, Homo sapiens; identical to SEQ ID NO: 536484
  misc_feature: HIJSMM301EPI3O.8.11.A11.1.454.light.4.raw

SEQ ID NO: 598403 - DNA, 505 bp, Homo sapiens; identical to SEQ ID NO: 535503
  misc_feature: HIJSMM301B44Y0.8.28.C06.1.454.light.4.raw

SEQ ID NO: 598404 - DNA, 488 bp, Homo sapiens
  misc_feature: HIJSMM301A7IS1.26.70.G04.1.454.light.4.raw
agactatactcacgaccggtgctcgatttagtgtagtgtgaagggaaagggggcaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgtcgggcgagtcagggcattagcgtattttttagcctggtttcagcagaaaccagggaaagcccccaagtccctgatctatgctgcgtccactttagaaggtggagtcccatcaaggttcagcggcagtggatctgggacagagttcactctcaacatcagcagcctgcagcctgaggattttgcaacttattactgccagcaagtataatgattaccctatccaccttcggccgggggacacggctggaaactaaacgaactgtggctgcacc

SEQ ID NO: 598405 - DNA, 504 bp, Homo sapiens
  misc_feature: HIJSMM301BUSCP.18.26.C04.1.454.light.4.raw
tacgagtatgcacgaccggtgctcgatttagtctagcgactttgggtttgggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccgaaggtagagatcaaaggaactagtggctgcaccatctgtcttcatcttcccgccta

SEQ ID NO: 598406 - DNA, 512 bp, Homo sapiens
  misc_feature: HIJSMM301E29LN.4.10.A10.1.454.light.4.raw
agcactgtagcacgaccggtgctcgatttagcgtcgatctcgagggggggtagagaagacaggactcaggacaatctccagcatggccagcttccctctcctcctcaccctcctcactcactgtgcagggtcctgggcccactctgtgctgactcagccaccctcagcgtctcggggacccccgggcagagggtcaccatctcttgttctggaagcacctccaacatcggaagtaatcctgtaaactggttccagcaactcccaggaagggcccccaaagtcctcatctatggtcagaatcagcgtccctcaggggtccctgaccgattctctggctccaagtctgacacctcagcctccctggccatcagtgggctccagtctgaggatgaggctgattattactgtgcaacatgggatgacatcctacgtggtgcggtgttcggcggagggaccaagttgaccgtcctgggtcagcccaaggctcgccccctcggtcactctgttcccta

SEQ ID NO: 598407 - DNA, 494 bp, Homo sapiens; identical to SEQ ID NO: 549057
  misc_feature: HIJSMM301AOZ56.10.33.C11.1.454.light.4.raw

SEQ ID NO: 598408 - DNA, 497 bp, Homo sapiens; identical to SEQ ID NO: 536376
  misc_feature: HIJSMM301DVVUQ.22.9.A09.1.454.light.4.raw

SEQ ID NO: 598409 - DNA, 505 bp, Homo sapiens; identical to SEQ ID NO: 536254
  misc_feature: HIJSMM301CY98G.7.71.G05.1.454.light.4.raw

SEQ ID NO: 598410 - DNA, 502 bp, Homo sapiens; identical to SEQ ID NO: 543936
  misc_feature: HIJSMM301BEPR3.15.1.A01.1.454.light.4.raw

SEQ ID NO: 598411 - DNA, 524 bp, Homo sapiens
  misc_feature: HIJSMM301E23EE.12.71.G05.1.454.light.4.raw
atacgacgtacacgaccggtgctcgatttagtgtcgtcgcaagagagagggggggggtcgacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcgggcgggaccgaaagtgaccgtcctaagtcagcccaaggctgccccctcggtcactctgttcccaccct

SEQ ID NO: 598412 - DNA, 515 bp, Homo sapiens
  misc_feature: HIJSMM301AEVFS.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaaagcggggacccagaccctggagcctcagttggaagcagccgatccagcctgcggagcctgtggggcaggtcagcccaaggccaaccccactgtcact

SEQ ID NO: 598413 - DNA, 488 bp, Homo sapiens
  misc_feature: HIJSMM301EZ3ZP.15.28.C06.1.454.light.4.raw
tctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcagcggcagtggatctgggacagaattcagtctcaccatcagcagcctgcagccctgacgattttgcaacttactactgccaagtgcataataatcatttcggcggagggaccaaggtggagatacaaacgaactgtggctgcaccatctgtcttcatt

SEQ ID NO: 598414 - DNA, 507 bp, Homo sapiens
  misc_feature: HIJSMM301DLYWG.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccgaagctgaccgtcctgggtcagcccaaggctcgccccctcggtcactctgttcccgccctcctctacgtcgtat

SEQ ID NO: 598415 - DNA, 506 bp, Homo sapiens
  misc_feature: HIJSMM301A4R00.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggccgtccgggggccactttcggccctgggaccaaagtggatatcaaacgaactagtggctgcaccatctgtt

SEQ ID NO: 598416 - DNA, 504 bp, Homo sapiens; identical to SEQ ID NO: 555965
  misc_feature: HIJSMM301B19GR.48.36.D03.1.454.light.4.raw

SEQ ID NO: 598417 - DNA, 505 bp, Homo sapiens; identical to SEQ ID NO: 536254
  misc_feature: HIJSMM301CMYZF.7.71.G05.1.454.light.4.raw

SEQ ID NO: 598418 - DNA, 518 bp, Homo sapiens
  misc_feature: HIJSMM301EKENV.41.25.C03.1.454.light.4.raw
tctatactatcacgaccggtgctcgatttagtagtgtagatttgggtttgggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggtttctggctccatcgacagtccctccaactccgcctcccttaccatatctgggctgaagagtgaggacgaggctgactacttctgtcagtcttatgatataaacaattatgtgataattggcggagggaccagggtgaccgtcctaggtcagcccaaggctgccccctcggtcactctgttcccta

SEQ ID NO: 598419 - DNA, 502 bp, Homo sapiens
  misc_feature: HIJSMM301BFGCI.43.34.D01.1.454.light.4.raw
tgtgagtagtcacgaccggtgctcgatttagatcgtctgtgttgggtttggggggggtcgacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtctaggtcagcccaaggccaacccccta

SEQ ID NO: 598420 - DNA, 474 bp, Homo sapiens; identical to SEQ ID NO: 574375
  misc_feature: HIJSMM301ERV96.18.76.G10.1.454.light.4.raw

SEQ ID NO: 598421 - DNA, 485 bp, Homo sapiens; identical to SEQ ID NO: 536040
  misc_feature: HIJSMM301CMHPG.15.1.A01.1.454.light.4.raw

SEQ ID NO: 598422 - DNA, 504 bp, Homo sapiens; identical to SEQ ID NO: 535709
  misc_feature: HIJSMM301ALV7M.9.55.E11.1.454.light.4.raw

SEQ ID NO: 598423 - DNA, 498 bp, Homo sapiens; identical to SEQ ID NO: 537020
  misc_feature: HIJSMM301DT5FW.26.26.C04.1.454.light.4.raw

SEQ ID NO: 598424 - DNA, 507 bp, Homo sapiens
  misc_feature: HIJSMM301CVLTS.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcgggcgttcggccaagggaccgaaggtaggaaatacaaacgaactagtggctgcaccatctgtcttcatcttccccg

SEQ ID NO: 598425 - DNA, 501 bp, Homo sapiens; identical to SEQ ID NO: 568432
  misc_feature: HIJSMM301DE05S.2.49.E05.1.454.light.4.raw

SEQ ID NO: 598426 - DNA, 506 bp, Homo sapiens; identical to SEQ ID NO: 551204
  misc_feature: HIJSMM301EXWOU.15.59.F04.1.454.light.4.raw

SEQ ID NO: 598427 - DNA, 505 bp, Homo sapiens
  misc_feature: HIJSMM301AUH8X.43.86.H09.1.454.light.4.raw
tgtgagtagtcacgaccggtgctcgatttagtgctatagacttgggtttggggatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactctggggtcccagacagattcagcggcagtgggtctggcactgatttcacactgacaatcagcagggtggaggctgaggatgttgggttttattactgcatgcaaacttcacactggcctccgttcacttttggccaggggaccaaggtggagatcaaacgaactgtggctgcaccatctgtt

SEQ ID NO: 598428 - DNA, 484 bp, Homo sapiens; identical to SEQ ID NO: 535240
  misc_feature: HIJSMM301BINH5.47.60.F05.1.454.light.4.raw

SEQ ID NO: 598429 - DNA, 496 bp, Homo sapiens
  misc_feature: HIJSMM301BMCGE.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgcagtttattactgtcagcagtatgatacctggcctccgtacacttttggccgggggaccaaggctggaatcaagcgaactgtggctgcaccatctgtcttcattccc

SEQ ID NO: 598430 - DNA, 506 bp, Homo sapiens; identical to SEQ ID NO: 542696
  misc_feature: HIJSMM301DU8D7.7.71.G05.1.454.light.4.raw

SEQ ID NO: 598431 - DNA, 507 bp, Homo sapiens
  misc_feature: HIJSMM301CPZ6W.40.47.E03.1.454.light.4.raw
tctagcgactcacgaccggtgctcgatttagactcgcgcacagagagaaggggtggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccaataatgacgttggtggttacaactatgtctcctggtaccaacaatacccaggcaaagcccccaaactcctgatttatgaggtcagtaagcggccctcaggggtccctgatcgcttctctggctccaagtctgtcaacacggcctccctgaccgtctctgggctccaggctgaggatgaggctgtttactactgcagctcatatgcaggcagcaataatttggtgttcggcgggggaccaagctgaccgtcctaggtcagcccaaggctgcccctcggtcact

SEQ ID NO: 598432 - DNA, 495 bp, Homo sapiens
  misc_feature: HIJSMM301BMOZ0.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcagggtggaggctgaggatgttggggtttggttcctccatgcaaggtacacactggccttttggtccaggggaccaacctggagatcaaatgaactgtggctgcaccatctgtctt

SEQ ID NO: 598433 - DNA, 489 bp, Homo sapiens
  misc_feature: HIJSMM301BIYL6.17.57.F02.1.454.light.4.raw
cgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagcaacttttttaaattggtatcagcgggaaccagggaaagcccctaaactcctgatctatactgcatccaatttgcaaagtggggtcccatcaaggttcagtggcagtggatctgggacagatttcactctcaccatcagcagtctgcaacctgaggattttgcaacttactactgtcaacagggttacagtaccccgtacacttttggccaggggaccaagctggagatcaaacgaactgtggctgcaccat

SEQ ID NO: 598434 - DNA, 483 bp, Homo sapiens; identical to SEQ ID NO: 561886
  misc_feature: HIJSMM301D71R5.40.83.H06.1.454.light.4.raw

SEQ ID NO: 598435 - DNA, 517 bp, Homo sapiens; identical to SEQ ID NO: 552807
  misc_feature: HIJSMM301DEDG6.10.26.C04.1.454.light.4.raw

SEQ ID NO: 598436 - DNA, 485 bp, Homo sapiens; identical to SEQ ID NO: 535606
  misc_feature: HIJSMM301COEAT.47.46.E02.1.454.light.4.raw

SEQ ID NO: 598437 - DNA, 518 bp, Homo sapiens
  misc_feature: HIJSMM301DALGD.7.87.H10.1.454.light.4.raw
cgtgtctctacacgaccggtgctcgatttagcagtactgcgttggggtttgggggagctgctcagttaggacccagagggaaccatggaaaccccagcgcagcttctcttcctcctgctactctggctcccagataccaccggagaaactgtgttgacacagtctccaggccaccctgtctttgtcgtccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccggacgtcggtccgacggacgaacggtaggaggtacaaacgaactagtggcgtgcgaccactctcgtcttctatccttccgtcccact

SEQ ID NO: 598438 - DNA, 483 bp, Homo sapiens; identical to SEQ ID NO: 535504
  misc_feature: HIJSMM301A3IL6.46.26.C04.1.454.light.4.raw

SEQ ID NO: 598439 - DNA, 497 bp, Homo sapiens; identical to SEQ ID NO: 535286
  misc_feature: HIJSMM301BVG1T.18.59.F04.1.454.light.4.raw

SEQ ID NO: 598440 - DNA, 495 bp, Homo sapiens; identical to SEQ ID NO: 535596
  misc_feature: HIJSMM301BBTQD.10.79.H02.1.454.light.4.raw

SEQ ID NO: 598441 - DNA, 493 bp, Homo sapiens; identical to SEQ ID NO: 537281
  misc_feature: HIJSMM301BAEMN.9.1.A01.1.454.light.4.raw

SEQ ID NO: 598442 - DNA, 491 bp, Homo sapiens; identical to SEQ ID NO: 535294
  misc_feature: HIJSMM301A5M2E.16.68.G02.1.454.light.4.raw

SEQ ID NO: 598443 - DNA, 487 bp, Homo sapiens
  misc_feature: HIJSMM301E2GMV.49.41.D08.1.454.light.4.raw
agtcgagagacacgaccggtgctcgatttagtcacgcgagaaagggaaaggggactgatcaggactcctcagttcaccttctcacaatgaggctccctgctcagctcctggggctgctaatgctctgggtctctggttccagtggggatattgtgatgactcagtctccactctccctgcccgtcacccctggagagccggcctccatctcctgcaggtctagtcagagcctcctgcatagcaatggatacaactatttggattggtacctgcagaagccagggcaggctccacagctcctgatctatttgggttcgaatcgggcctccggggtccctgacaggttcagtggcagtggatcaggcacagattttacactgaaaatcagcagagtggaggctgaggatgttgggatttattactgcatgcaagctctacaagctcctcagctcactttcggcggagggaccaaggtggagatcaaacg

SEQ ID NO: 598444 - DNA, 486 bp, Homo sapiens; identical to SEQ ID NO: 535043
  misc_feature: HIJSMM301ADQTR.46.35.D02.1.454.light.4.raw

SEQ ID NO: 598445 - DNA, 503 bp, Homo sapiens; identical to SEQ ID NO: 535140
  misc_feature: HIJSMM301EL2ZR.18.37.D04.1.454.light.4.raw

SEQ ID NO: 598446 - DNA, 463 bp, Homo sapiens; identical to SEQ ID NO: 535062
  misc_feature: HIJSMM301DPEGU.11.73.G07.1.454.light.4.raw

SEQ ID NO: 598447 - DNA, 513 bp, Homo sapiens; identical to SEQ ID NO: 576090
  misc_feature: HIJSMM301AUFQV.8.23.C01.1.454.light.4.raw

SEQ ID NO: 598448 - DNA, 485 bp, Homo sapiens
  misc_feature: HIJSMM301BSISX.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggcgcgggaccgacggtggagtgtcaagcgactagtggtcgtgcaccat

SEQ ID NO: 598449 - DNA, 507 bp, Homo sapiens
  misc_feature: HIJSMM301CFAC9.4.57.F02.1.454.light.4.raw
agcactgtagcacgaccggtgctcgatttagctcgatatagttgggtttggggctgggcctaaggaagcagcactggtggtgcctcagccatggcctgggccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactatactgtcaggtgtgggatagtagtggtgatcatccatacgtcttcggaactgggaccaaggtctccgtcctacgtcagcccaaggccaacccactgtcactctccg

SEQ ID NO: 598450 - DNA, 508 bp, Homo sapiens; identical to SEQ ID NO: 541988
  misc_feature: HIJSMM301EHM87.5.60.F05.1.454.light.4.raw

SEQ ID NO: 598451 - DNA, 511 bp, Homo sapiens; identical to SEQ ID NO: 537464
  misc_feature: HIJSMM301D3MMZ.7.34.D01.1.454.light.4.raw

SEQ ID NO: 598452 - DNA, 507 bp, Homo sapiens
  misc_feature: HIJSMM301DRUIX.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctggggacagacttcactctcaccatcagcagcctagagcctgaagattttgcagtttattactgtcaacatcgtaccgagtggcctccgggggccactttcggccctgggaccaaaattgagatcaaacgaaactgtggctgcaccatcctgtcttcatcttcccgcc

SEQ ID NO: 598453 - DNA, 447 bp, Homo sapiens
  misc_feature: HIJSMM301C8TZG.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagttatttggctgttcggcggcgggaccaagttgaccgtcctacgtcagcccaaggctcgccccctcggtcactctcgttcccgccctcctcgacacgcgag

SEQ ID NO: 598454 - DNA, 480 bp, Homo sapiens; identical to SEQ ID NO: 557442
  misc_feature: HIJSMM301BKWB0.8.53.E09.1.454.light.4.raw

SEQ ID NO: 598455 - DNA, 493 bp, Homo sapiens; identical to SEQ ID NO: 540127
  misc_feature: HIJSMM301BDJ1L.10.17.B06.1.454.light.4.raw

SEQ ID NO: 598456 - DNA, 505 bp, Homo sapiens
  misc_feature: HIJSMM301BZXSX.15.59.F04.1.454.light.4.raw
tctacgtagccacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatggtgctggcatttcggtcttcggcggagggaccaagctgaccgtcctaggtcagcccaaggctgccccctcggt

SEQ ID NO: 598457 - DNA, 507 bp, Homo sapiens
  misc_feature: HIJSMM301BWDXE.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagccccaaggcccaaaccccactgtcta

SEQ ID NO: 598458 - DNA, 482 bp, Homo sapiens
  misc_feature: HIJSMM301DV29F.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtggggctgaggatgttggcatttattactgcatgcaggctatacaccttcctgccacttttggccaggggccaagctggagatcgggcg

SEQ ID NO: 598459 - DNA, 498 bp, Homo sapiens
  misc_feature: HIJSMM301AR2W8.40.57.F02.1.454.light.4.raw
tctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttatttttgtctgctcttatgcaggcagttcgctctcgaagtgttcggcggagggaccgagctgaccgtcctacgtcagcccaaggctcg

SEQ ID NO: 598460 - DNA, 503 bp, Homo sapiens; identical to SEQ ID NO: 551458
  misc_feature: HIJSMM301AV9ZR.19.78.H01.1.454.light.4.raw

SEQ ID NO: 598461 - DNA, 488 bp, Homo sapiens; identical to SEQ ID NO: 535081
  misc_feature: HIJSMM301BKEZX.26.23.C01.1.454.light.4.raw

SEQ ID NO: 598462 - DNA, 490 bp, Homo sapiens
  misc_feature: HIJSMM301E1IFO.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaaactccttaacacttttggccaggggaccaagctggagatcaaaacgaa

SEQ ID NO: 598463 - DNA, 496 bp, Homo sapiens; identical to SEQ ID NO: 535423
  misc_feature: HIJSMM301EB4S5.3.33.C11.1.454.light.4.raw

SEQ ID NO: 598464 - DNA, 512 bp, Homo sapiens
  misc_feature: HIJSMM301BLPZ5.48.37.D04.1.454.light.4.raw
agtatacatacacgaccggtgctcgatttagtagcatactgttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgttcccaccct

SEQ ID NO: 598465 - DNA, 482 bp, Homo sapiens
  misc_feature: HIJSMM301B2AE9.52.35.D02.1.454.light.4.raw
cgcagtacgacacgaccggtgctcgatttagcacacgatagttgggtttgggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacggtatccctgatcgcttctcaggctccggctctgggactgagcgctacctcaccatctccagcctccagtctgaggacgagggtgactattactgtcagacgtgggacactggcatttgggtgttcggcggagggaccaagttgaccgtctaggtcagcccaggctcg

SEQ ID NO: 598466 - DNA, 300 bp, Homo sapiens
  misc_feature: HIJSMM301EFN0F.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaaagcccccaaactcctcattacta

SEQ ID NO: 598467 - DNA, 520 bp, Homo sapiens
  misc_feature: HIJSMM301CO1FC.14.33.C11.1.454.light.4.raw
  modified_base (511)..(511): a, c, t, g, unknown or other
cgtctagtaccacgaccggtgctcgatttagagtgagctcgttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctcgccccctcggtacnctcttccgg

SEQ ID NO: 598468 - DNA, 498 bp, Homo sapiens
  misc_feature: HIJSMM301AQZX4.51.25.C03.1.454.light.4.raw
cgatcgtatacacgaccggtgctcgatttagtagtgtagatttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggctgcgattttcggcggagggccagtctgaccgtcctaggtcagcccaaggctgccccctcggtcactctcg

SEQ ID NO: 598469 - DNA, 468 bp, Homo sapiens; identical to SEQ ID NO: 566950
  misc_feature: HIJSMM301DOCN6.49.79.H02.1.454.light.4.raw

SEQ ID NO: 598470 - DNA, 504 bp, Homo sapiens
  misc_feature: HIJSMM301BLN1V.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcagggtttctcatcgcttctctggctccaaatctggcaacacggcctcctgaccatctctgggctcgagtctgaggacgaggctgattacttctgttgctcttggcaactactgtcgtttgggtgttcggcggaggaccaagttgaccgtctaggtcagccaaggctcgccccctcggtcactctgtt

SEQ ID NO: 598471 - DNA, 488 bp, Homo sapiens
  misc_feature: HIJSMM301BBD4J.43.33.C11.1.454.light.4.raw
  modified_base (462)..(462): a, c, t, g, unknown or other
tgtgagtagtcacgaccggtgctcgatttagagtgagctcgttgggtttgggggcagaagtctctctcagtcaggacacagcatggacatgagggtccctgctcagctcctgggactcctgctgctctggctcccagcagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctccccctacaatttcggtcaggggaccaagttnaacatcaatcgaactgtggctgcacc

SEQ ID NO: 598472 - DNA, 507 bp, Homo sapiens
  misc_feature: HIJSMM301EKA64.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggcccaacccactgtcta

SEQ ID NO: 598473 - DNA, 507 bp, Homo sapiens; identical to SEQ ID NO: 561702
  misc_feature: HIJSMM301EOYT5.5.24.C02.1.454.light.4.raw

SEQ ID NO: 598474 - DNA, 496 bp, Homo sapiens
  misc_feature: HIJSMM301D9DOC.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggcagtttattactgtcagcagtattatactactcctctgacgttcggccaagggaccaaggtggaggatcaaacgaactagtggctgcaccat

SEQ ID NO: 598475 - DNA, 501 bp, Homo sapiens
  misc_feature: HIJSMM301ARHI5.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggtccaagggaccaaaggtgggagtatcagacgaactagtggctgg

SEQ ID NO: 598476 - DNA, 485 bp, Homo sapiens
  misc_feature: HIJSMM301CNUVG.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttatcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaaggaccaaggtggatatcagacgaa

SEQ ID NO: 598477 - DNA, 471 bp, Homo sapiens; identical to SEQ ID NO: 536918
  misc_feature: HIJSMM301CR5N7.4.75.G09.1.454.light.4.raw

SEQ ID NO: 598478 - DNA, 486 bp, Homo sapiens; identical to SEQ ID NO: 535043
  misc_feature: HIJSMM301EJEFP.46.35.D02.1.454.light.4.raw

SEQ ID NO: 598479 - DNA, 496 bp, Homo sapiens
  misc_feature: HIJSMM301CE5RW.43.39.D06.1.454.light.4.raw
tgtgagtagtcacgaccggtgctcgatttagtgacatctcgcagttctttgggggaagagctgctcagttaggacccagagggaaccatggaaaccccagcgcagcttctcttcctcctgctactctggctcccagatgccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtctt

SEQ ID NO: 598480 - DNA, 444 bp, Homo sapiens; identical to SEQ ID NO: 535192
  misc_feature: HIJSMM301DS4G1.5.9.A09.1.454.light.4.raw

SEQ ID NO: 598481 - DNA, 495 bp, Homo sapiens
  misc_feature: HIJSMM301B1LU4.4.72.G06.1.454.light.4.raw
agcactgtagcacgaccggtgctcgatttagctacgactgcaagggaaagggggaggaactgctcagttaggacccagacggaaccatggaagccccagcgcagcttctcttcctcctgctactctggctcccagaaagcagtggagaagtagtgatgacgcagtctccagccaccctgcctgtgtctccaggggacactgccaccctctcctgcagggccagtcagagtgttggcactaatttagcctggtaccagcagaaacctggccaagctcccaggctgctcatctataatacaatcacaagggacattggtgtcccagacaggttcagcggcagtgggtctgggacagagttcactctcactatcagcagcctgcactttgaagattttgcagtctatcattgtcagcagtataattggtggcctcggacgttcggccgacgggaccgaaggtaggaaagtacaaacgaactagtggctggcaccacta

SEQ ID NO: 598482 - DNA, 489 bp, Homo sapiens; identical to SEQ ID NO: 535139
  misc_feature: HIJSMM301AJPKO.14.55.E11.1.454.light.4.raw

SEQ ID NO: 598483 - DNA, 509 bp, Homo sapiens
  misc_feature: HIJSMM301D44NU.4.28.C06.1.454.light.4.raw
agcactgtagcacgaccggtgctcgatttagagctcacgtattgggtttggggctgggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgacttgggggagagatatgtttcctggtatctccagaggccaggccactcccctattctagtcatgtatcaaactacgaagcgcccctcaggggtccctgagcgcttttctggctccaagtctggggacacagccactctgactctctccggggcccaggccatcgatgagggagactattactgtcaggcgtgggacagcacaactgcagtcttcggcggagggaccagggtgaccgtcctgggtcagcccaaggctgccccctcggtcactctgttcccaccctt

SEQ ID NO: 598484 - DNA, 518 bp, Homo sapiens; identical to SEQ ID NO: 593188
  misc_feature: HIJSMM301DWRAI.14.70.G04.1.454.light.4.raw

SEQ ID NO: 598485 - DNA, 490 bp, Homo sapiens
  misc_feature: HIJSMM301BBZE2.48.10.A10.1.454.light.4.raw
agtatacatacacgaccggtgctcgatttagcgtcgatctcagggggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggtccaagggaccgagggtggaagtacgaacgaactagtggcgtgcaccatctgtcttt

SEQ ID NO: 598486 - DNA, 492 bp, Homo sapiens
  misc_feature: HIJSMM301DRQTM.47.62.F07.1.454.light.4.raw
  modified_base (491)..(491): a, c, t, g, unknown or other
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaaactatttaaattggtatcagcagaaaccagggaaagcccctaagctcctgatctacgatgcatccaatttggaaacaggggtcccatcaaggttcagtggaagtggatctgggacagattttacttcaccatcagcagcctgcagcctgaagatattgcaacatattactgtcaacagtatcataatctccccactttcggtccctcgggaccaaagtaggatatacaaacgaaactgtggctgccacactcgtnt

SEQ ID NO: 598487 - DNA, 494 bp, Homo sapiens; identical to SEQ ID NO: 534994
  misc_feature: HIJSMM301AR4PX.27.78.H01.1.454.light.4.raw

SEQ ID NO: 598488 - DNA, 496 bp, Homo sapiens; identical to SEQ ID NO: 535109
  misc_feature: HIJSMM301BNF3B.16.78.H01.1.454.light.4.raw

SEQ ID NO: 598489 - DNA, 491 bp, Homo sapiens
  misc_feature: HIJSMM301BK8VV.51.71.G05.1.454.light.4.raw
cgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggcccaaccca

SEQ ID NO: 598490 - DNA, 488 bp, Homo sapiens
  misc_feature: HIJSMM301A3JXK.49.20.B09.1.454.light.4.raw
agtcgagagacacgaccggtgctcgatttagtgtagtgtgaagggcttgatgccttggggtgggaggagagacccctcccctgggatcctgcagctctagtctcccgtggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacaatatgcttactggtaccagcagaggccaggccaggcccctgtcttggtgatttataaagactttgagaggccctcacgggacccctgagcgattctctggctccagctcagggacaacagtcacttgaccatcagtggagtccggccaggaggacgaggctgactattactgtcagtccgcagacagcagtggcagtt

SEQ ID NO: 598491 - DNA, 490 bp, Homo sapiens; identical to SEQ ID NO: 535234
  misc_feature: HIJSMM301BCM1W.17.21.B10.1.454.light.4.raw

SEQ ID NO: 598492 - DNA, 507 bp, Homo sapiens
  misc_feature: HIJSMM301COI50.47.85.H08.1.454.light.4.raw
agctcacgtacacgaccggtgctcgatttagtatcactcagtcgcgggggctggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactc

SEQ ID NO: 598493 - DNA, 502 bp, Homo sapiens; identical to SEQ ID NO: 575571
  misc_feature: HIJSMM301BCW2U.12.67.G01.1.454.light.4.raw

SEQ ID NO: 598494 - DNA, 505 bp, Homo sapiens; identical to SEQ ID NO: 542754
  misc_feature: HIJSMM301CIY4M.4.57.F02.1.454.light.4.raw

SEQ ID NO: 598495 - DNA, 503 bp, Homo sapiens
  misc_feature: HIJSMM301CRPWJ.15.86.H09.1.454.light.4.raw
  modified_base (493)..(493): a, c, t, g, unknown or other
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctgcactctcgtcccncctctcgcta

SEQ ID NO: 598496 - DNA, 475 bp, Homo sapiens
  misc_feature: HIJSMM301CT78Z.52.4.A04.1.454.light.4.raw
cgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgttctggagataaaatggaggataaatatgtttcctggtatcgccagaagccaggccagtcgcctgtcctggtcatctatcacgataagaagcggccctcagggatccctgagcgattctctggctccaaactctgggaacacagccactctgaccatcagcgggacccaggctatggatgaggctgactattactgtcagccgtgggacagaagcactctggtgttcggcggagggaccaggctgaccgtcctaggtcagcccaaggctg

SEQ ID NO: 598497 - DNA, 517 bp, Homo sapiens
  misc_feature: HIJSMM301AMVBU.12.71.G05.1.454.light.4.raw
atacgacgtacacgaccggtgctcgatttagtgtcgtcgcaagagagagggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgatttttggaaattttgacctagtctcctggtaccaacaataccccggcaaagtccccaagttaatcatttatgaggacactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaagtgaccgtcctaagtcagcccaaggctgccccctcggtcactctgttcccgccct

SEQ ID NO: 598498 - DNA, 486 bp, Homo sapiens; identical to SEQ ID NO: 544417
  misc_feature: HIJSMM301CDPF6.41.21.B10.1.454.light.4.raw

SEQ ID NO: 598499 - DNA, 506 bp, Homo sapiens
  misc_feature: HIJSMM301D7OWT.12.86.H09.1.454.light.4.raw
atacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattcttttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgaagattttgcagtttattactgtcagcagcgtagcaactggcctcggttcacttttggccaggggaccaagctggagatcaaacgaactgtggctgcaccatctgtcttcatcttccccg

SEQ ID NO: 598500 - DNA, 484 bp, Homo sapiens; identical to SEQ ID NO: 537427
  misc_feature: HIJSMM301CTEF1.26.78.H01.1.454.light.4.raw

SEQ ID NO: 598501 - DNA, 494 bp, Homo sapiens; identical to SEQ ID NO: 535276
  misc_feature: HIJSMM301BR5JY.16.6.A06.1.454.light.4.raw

SEQ ID NO: 598502 - DNA, 504 bp, Homo sapiens; identical to SEQ ID NO: 535495
  misc_feature: HIJSMM301ES5UE.14.86.H09.1.454.light.4.raw

SEQ ID NO: 598503 - DNA, 491 bp, Homo sapiens
  misc_feature: HIJSMM301CJCYZ.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcgggactttcggcggagggaccgaaggtggaggatacaaacgaaa

SEQ ID NO: 598504 - DNA, 489 bp, Homo sapiens; identical to SEQ ID NO: 592864
  misc_feature: HIJSMM301AUTIF.12.88.H11.1.454.light.4.raw

SEQ ID NO: 598505 - DNA, 419 bp, Homo sapiens
  misc_feature: HIJSMM301EGIXN.18.78.H01.1.454.light.4.raw
tacgagtatgcacgaccggtgctcgatttagtgtgagtagtttgggtttgggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggcccaacccactgtcactctgttcccgccctcctccatactcgta

SEQ ID NO: 598506 - DNA, 467 bp, Homo sapiens; identical to SEQ ID NO: 538403
  misc_feature: HIJSMM301BLZ0Y.41.48.E04.1.454.light.4.raw

SEQ ID NO: 598507 - DNA, 526 bp, Homo sapiens
  misc_feature: HIJSMM301EAUS6.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggccgaacgggaccgaacggtaggaaggtacaaacgaaactagtggcgtgcaccatctcgtcttctactcttcccgtcccactctcgat

SEQ ID NO: 598508 - DNA, 495 bp, Homo sapiens
  misc_feature: HIJSMM301BXXF7.51.83.H06.1.454.light.4.raw
cgatcgtatacacgaccggtgctcgatttagatcacgtgcgtcgcggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagtttattattgtcagcagcgaaacaactggcctccttggacgttcggccaagggaccaaggtggaaatcaaacgaactgtggctgcaccatctgtcttcatt

SEQ ID NO: 598509 - DNA, 521 bp, Homo sapiens; identical to SEQ ID NO: 538715
  misc_feature: HIJSMM301CYKLT.27.23.C01.1.454.light.4.raw

SEQ ID NO: 598510 - DNA, 498 bp, Homo sapiens
  misc_feature: HIJSMM301CAUQY.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctctatttactgggcgtctacccgggaatccggggtccctgaccgattcagtggcaggcgggtctgggacagatttcactctcaccatcagcagcctgcaggttgaagatgtggctagtttattactgtcagcagtattatactactcctctgacgttcggccaagggaccaaggtggagatacaaacgaactgtggctgcaccat

SEQ ID NO: 598511 - DNA, 489 bp, Homo sapiens; identical to SEQ ID NO: 535139
  misc_feature: HIJSMM301DM4I7.14.55.E11.1.454.light.4.raw

SEQ ID NO: 598512 - DNA, 487 bp, Homo sapiens; identical to SEQ ID NO: 555619
  misc_feature: HIJSMM301CWJXH.46.35.D02.1.454.light.4.raw

SEQ ID NO: 598513 - DNA, 444 bp, Homo sapiens; identical to SEQ ID NO: 535192
  misc_feature: HIJSMM301BVDT2.5.9.A09.1.454.light.4.raw

SEQ ID NO: 598514 - DNA, 519 bp, Homo sapiens; identical to SEQ ID NO: 547713
  misc_feature: HIJSMM301BDP6J.5.27.C05.1.454.light.4.raw

SEQ ID NO: 598515 - DNA, 507 bp, Homo sapiens; identical to SEQ ID NO: 541461
  misc_feature: HIJSMM301A072A.11.57.F02.1.454.light.4.raw

SEQ ID NO: 598516 - DNA, 365 bp, Homo sapiens
  misc_feature: HIJSMM301BS09V.53.5.A05.1.454.light.4.raw
cgcgtatacacacgaccggtgctcgatttagatagatagacaggatcacctgctctggagatggattgccaaagcactatggttactggtaccaacagaagccaggccaggcccctctattggtaatgtataaagacaatgagaggccctcagggatccctgagcgattctctggctccaactcagggacaacagtcacgttgaccatcggtggagtccaggcagaagacgaggctgactattactgtcaatcagcaggcagcagtggaactgtgcttttcggcggagggaccaagctgaccgtcctacgtcagcccaaggctgccccctcggtcactctgttcccaccctcctctcgtactgcg

SEQ ID NO: 598517 - DNA, 503 bp, Homo sapiens
  misc_feature: HIJSMM301CFNDU.13.50.E06.1.454.light.4.raw
tcacgtactacacgaccggtgctcgatttagatctactgacaacacacaagggggctgtaggctcaggaggcagagctctgaatgtctcaccatggcctggatccctctcctgctccccctcctcattctctgcacagtctctgtgacctcctatgaactgacacagccatcctcagtgtcagtgtctccgggacagacggccaggatcacctgctcaggaaatattctgaacaaaaaatatgctcggtggttccagcagaagccaggccaggccccagtactggtgatttataaagacattgagcggccctcagggatccctgagcgattctccggctctaattcagggaccacagtcaccttgaccatcaccggggcccagattgaggatgaggctgactattattgttactctgcggctgacaaccatctggttttcggcgggggaccaagttgaccgtcgtgggtcagcccaaggctcgccccctcggtcactcttccg

SEQ ID NO: 598518 - DNA, 497 bp, Homo sapiens; identical to SEQ ID NO: 545672
  misc_feature: HIJSMM301CA6BY.2.49.E05.1.454.light.4.raw

SEQ ID NO: 598519 - DNA, 493 bp, Homo sapiens; identical to SEQ ID NO: 535047
  misc_feature: HIJSMM301DWZF0.16.53.E09.1.454.light.4.raw

SEQ ID NO: 598520 - DNA, 497 bp, Homo sapiens; identical to SEQ ID NO: 538382
  misc_feature: HIJSMM301AQ64D.3.33.C11.1.454.light.4.raw

SEQ ID NO: 598521 - DNA, 495 bp, Homo sapiens
  misc_feature: HIJSMM301AGI6Q.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacgaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttccccg

SEQ ID NO: 598522 - DNA, 506 bp, Homo sapiens
  misc_feature: HIJSMM301ASWNC.21.22.B11.1.454.light.4.raw
tcgtcgctcgcacgaccggtgctcgatttagacgacagctcagggtggggtcaaaaacccggggaggggggtctgatttgcatggatggactctccccctctcagagtacgaagagagggagagatctgggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggccgaggatgaggctgactattact

SEQ ID NO: 598523 - DNA, 508 bp, Homo sapiens
  misc_feature: HIJSMM301A2IXD.13.42.D09.1.454.light.4.raw
tcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctcggacgttcggtccgaacgggaccgaacggtagggaaatacaaacgaaactacgtggcgtgcgaccactctcgttcg

SEQ ID NO: 598524 - DNA, 485 bp, Homo sapiens; identical to SEQ ID NO: 550102
  misc_feature: HIJSMM301CQLI3.41.50.E06.1.454.light.4.raw

SEQ ID NO: 598525 - DNA, 519 bp, Homo sapiens; identical to SEQ ID NO: 547713
  misc_feature: HIJSMM301EPFTX.5.27.C05.1.454.light.4.raw

SEQ ID NO: 598526 - DNA, 500 bp, Homo sapiens
  misc_feature: HIJSMM301D4CGO.41.12.B01.1.454.light.4.raw
tctatactatcacgaccggtgctcgatttagtagtgtagattccgcgggcacgaccggtgctcgatttagagctcacgtaagggggaggaactgctcagttaggacccagacggaaccatggaagccccagcgcagcttctcttcctcctgctactctggctcccagataccactggagacatagtgatgacgcagtctccagccaccctgtctgtgtctccaggggagacagccaccctctcctgcagggccagtcagagtgttagtaacaacttagcatggtaccagcagaaacctggccaggctcccaggctcctcatctatcgtgcgtccaccagggcaactggtatcccagccaggttcagtggcgttgggtctgggacagagttcactctcaccatcaccagcctgcagtctgaagattttgctagtttattactgtcaccaatataataactggtacacttttggccagggaccaagctcgagatcaaacgaa

SEQ ID NO: 598527 - DNA, 494 bp, Homo sapiens
  misc_feature: HIJSMM301B8C3C.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctcctgaacatctctgggctccaggctgaggatgaggctgattattattgctgctcatatggaagtacctacttcttttctcttcggaactgggaccacggtcaccgtctaggtcagcccaaggcccaaccc

SEQ ID NO: 598528 - DNA, 482 bp, Homo sapiens
  misc_feature: HIJSMM301AJIAA.7.67.G01.1.454.light.4.raw
cgtgtctctacacgaccggtgctcgatttagagtatacatattgggtttgggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctcccacagcggggcaggttctgatgttcactggtaccagcagcttccagggacagcccccaaactcctcatatacgagaacaccaatccggccctcaggagtccctgaccgattctctggctccaagtctggcacctcagccctccctggccatcactgggctccaggctggaggatggaggctgattattactgccagtcgtatgacagcagcctgagtgtttgggtgttcggcggaggacc

SEQ ID NO: 598529 - DNA, 505 bp, Homo sapiens; identical to SEQ ID NO: 555744
  misc_feature: HIJSMM301DZSSV.7.71.G05.1.454.light.4.raw

SEQ ID NO: 598530 - DNA, 494 bp, Homo sapiens; identical to SEQ ID NO: 534994
  misc_feature: HIJSMM301BP9DE.27.78.H01.1.454.light.4.raw

SEQ ID NO: 598531 - DNA, 362 bp, Homo sapiens; identical to SEQ ID NO: 586742
  misc_feature: HIJSMM301DYDOZ.3.57.F02.1.454.light.4.raw

SEQ ID NO: 598532 - DNA, 484 bp, Homo sapiens; identical to SEQ ID NO: 535211
  misc_feature: HIJSMM301DKS9M.47.46.E02.1.454.light.4.raw

SEQ ID NO: 598533 - DNA, 507 bp, Homo sapiens
  misc_feature: HIJSMM301CLEMR.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcgggcggagggaccaagctgaccgtcctgggtcagcccaaggctgccccctcggtctacc

SEQ ID NO: 598534 - DNA, 485 bp, Homo sapiens; identical to SEQ ID NO: 570410
  misc_feature: HIJSMM301CA3UG.26.23.C01.1.454.light.4.raw

SEQ ID NO: 598535 - DNA, 511 bp, Homo sapiens
  misc_feature: HIJSMM301BZZKD.15.34.D01.1.454.light.4.raw
  modified_base (493)..(493): a, c, t, g, unknown or other
tctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggcatttgggtgttcggcggagggaccaaactgaccgtcctaggtcagcccaaggctgccccctcggtcactctgttcccnccctcctcgctacgtaga

SEQ ID NO: 598536 - DNA, 484 bp, Homo sapiens; identical to SEQ ID NO: 541607
  misc_feature: HIJSMM301BLQKF.17.26.C04.1.454.light.4.raw

SEQ ID NO: 598537 - DNA, 485 bp, Homo sapiens; identical to SEQ ID NO: 539315
  misc_feature: HIJSMM301D5CA8.3.88.H11.1.454.light.4.raw

SEQ ID NO: 598538 - DNA, 513 bp, Homo sapiens
  misc_feature: HIJSMM301BL55Z.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccacccttaccatcagcagggtcgaagccggggatgaggccgactattactgtcaggtgtgggatagtagtggtgatcatccatacgtcttcggaactgggaccaaggtctccgtcctacgtcagcccaaggccaaccccactgtcactctgttcccaccct

SEQ ID NO: 598539 - DNA, 497 bp, Homo sapiens
  misc_feature: HIJSMM301DTNST.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtacacttttggccagggggaccccaggtggagatcagacgaactgtggctgcaccatctgtcttcatcttcccg

SEQ ID NO: 598540 - DNA, 490 bp, Homo sapiens
  misc_feature: HIJSMM301EFH8J.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcacagcctgcaactgatgattttgcaacttattactgccaacagtatcatcatcattgtaatttcggtgggaggaccaaagggtggaggtcaaacgaactgtggctgcacatctgtcttcatt

SEQ ID NO: 598541 - DNA, 492 bp, Homo sapiens
  misc_feature: HIJSMM301AOVD6.26.37.D04.1.454.light.4.raw
  modified_base (490)..(490): a, c, t, g, unknown or other
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaatttattactgtcagcaatataataacctggcctccgctcacttcgtcggagggacgaacggtagtaggatacaaacgaactagtggctgcnca

SEQ ID NO: 598542 - DNA, 488 bp, Homo sapiens
  misc_feature: HIJSMM301AS8FV.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaaggtggataatcagacgaa

SEQ ID NO: 598543 - DNA, 522 bp, Homo sapiens
  misc_feature: HIJSMM301DH3S8.12.71.G05.1.454.light.4.raw
atacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttggggtgttcggcggcggggaccaaagtgaccgtcctaagtcagcccaaggctgccccctcggtcactctgttcccaccct

SEQ ID NO: 598544 - DNA, 502 bp, Homo sapiens
  misc_feature: HIJSMM301C2RKL.9.71.G05.1.454.light.4.raw
tgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctgtccccccg

SEQ ID NO: 598545 - DNA, 441 bp, Homo sapiens; identical to SEQ ID NO: 534971
  misc_feature: HIJSMM301D7L9B.11.3.A03.1.454.light.4.raw

SEQ ID NO: 598546 - DNA, 505 bp, Homo sapiens
  misc_feature: HIJSMM301COLDC.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaagggtggacctcaaacgaactgtggctgcaccatctgtcttcatcttcccgc

SEQ ID NO: 598547 - DNA, 501 bp, Homo sapiens
  misc_feature: HIJSMM301DMCP3.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcccgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtccgctcactttcggcgggggaccgaaggtggagttcaaacgaactgtggctgcaccatctgtcttcatcttccccg

SEQ ID NO: 598548 - DNA, 496 bp, Homo sapiens
  misc_feature: HIJSMM301ECPAU.40.50.E06.1.454.light.4.raw
tctagcgactcacgaccggtgctcgatttagatctactgacaacacacaaggggggggtcgacaagaggcagcgctctcgggacggtctccaccatggcctgggctctgctgctcctcactctcctcactcaggacacagggtcctgggcccagtctgccctgactcagcctgcctccgtgtctgggtctcctggacagtcgatcaccatctcctgcactggagacaccggtgatattgggacttataaccttgtctcttggtaccaacagcacccaggcaaagcccccaaacttatgatttatgagggcagccagcggccctcatggatttctagtcgcttctctgcctccaagtctggcaacacggcctccctgacaatctctggactccaggctgaggacgaggctgagtattactgctgcgcatttgcaggtagtagcgccccttatgtcttcgggactgggaccaaggtcacagtcctaggcagcccaagg

SEQ ID NO: 598549 - DNA, 496 bp, Homo sapiens; identical to SEQ ID NO: 536248
  misc_feature: HIJSMM301C8BRQ.22.27.C05.1.454.light.4.raw

SEQ ID NO: 598550 - DNA, 497 bp, Homo sapiens
  misc_feature: HIJSMM301C4OG4.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtcctaggtccagcccaaggcccaaccca

SEQ ID NO: 598551 - DNA, 487 bp, Homo sapiens
  misc_feature: HIJSMM301D3DO2.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttggccaagggaccaaggtaggataatcagacgaa

SEQ ID NO: 598552 - DNA, 488 bp, Homo sapiens
  misc_feature: HIJSMM301DG4O9.5.34.D01.1.454.light.4.raw
atcagacacgcacgaccggtgctcgatttagatcgtctgtgttggggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgctaacttactattgtcaacaggctaacagtttccctccgaccttcggccaacggacacgactggagaattaaacgaactagtggctgcaccta

SEQ ID NO: 598553 - DNA, 485 bp, Homo sapiens; identical to SEQ ID NO: 535985
  misc_feature: HIJSMM301CK3HW.15.1.A01.1.454.light.4.raw

SEQ ID NO: 598554 - DNA, 495 bp, Homo sapiens; identical to SEQ ID NO: 535007
  misc_feature: HIJSMM301CSPJG.22.5.A05.1.454.light.4.raw

SEQ ID NO: 598555 - DNA, 518 bp, Homo sapiens
  misc_feature: HIJSMM301BAFJW.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctcggacccctgcccgattctcaggcctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctcgccccctcggtcactctcgttcccaccctcct

SEQ ID NO: 598556 - DNA, 503 bp, Homo sapiens; identical to SEQ ID NO: 584633
  misc_feature: HIJSMM301APCP4.43.38.D05.1.454.light.4.raw

SEQ ID NO: 598557 - DNA, 516 bp, Homo sapiens
  misc_feature: HIJSMM301EHJ2V.9.2.A02.1.454.light.4.raw
tgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggtggctctaatcatgtctcctggtactataacagtccaggcaaagcccccaaactcataatttatgatgtctttagacggccctcagggatttcttctcggttgtctggctccaagtctgggaacacggcctccctgaccatctctggacttcagcctgaggacgagggtgattacttctgcagttcagattcagaaacttccctcgttgggtgttcggcggagggaccatgctgaccgtcctgagtcagcccaaggctgccccctcggtcactctgttcccgccct

SEQ ID NO: 598558 - DNA, 493 bp, Homo sapiens; identical to SEQ ID NO: 535745
  misc_feature: HIJSMM301AIYHB.47.78.H01.1.454.light.4.raw

SEQ ID NO: 598559 - DNA, 491 bp, Homo sapiens
  misc_feature: HIJSMM301EI2WA.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagcccccaagtcgttctctatgatgtcactaagcggccctcaggagtccctgatcgattctctggctccaagtctggcaacacggcctccctgaacatctctgggctccaggctgaggatgaggctgattatattgctgctcatatggaagtacctactcttttctcttcggaactgggaccacggtcacgtcctaggtcagcccaaggccaaccc

SEQ ID NO: 598560 - DNA, 501 bp, Homo sapiens
  misc_feature: HIJSMM301BP3VJ.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggtcaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtctt

SEQ ID NO: 598561 - DNA, 501 bp, Homo sapiens
  misc_feature: HIJSMM301CT594.12.67.G01.1.454.light.4.raw
atacgacgtacacgaccggtgctcgatttagagtatacatattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcagagcccccaaactcatgatttttgatgtcactaatcggccctcaggggtttctgatcgcttctctggctccaagtctgactacacggcctccctgaccatctctgggctccaggctgaggacgaggctgattattattgcagctcatatacaagcagcagcaccctctttgtcttcggaagtgggaccaaggtcaccgtctacgtcagcccaaggccaaccca

SEQ ID NO: 598562 - DNA, 472 bp, Homo sapiens
  misc_feature: HIJSMM301CZBYY.4.54.E10.1.454.light.4.raw
agcactgtagcacgaccggtgctcgatttagatcgtagcagaacacacaaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcagcatcacttgccgggcaagtcagagcattagcacttttttaagttggtatcagcagacaccagggaaagcccctaagctcctgatctatgctgcttccagtttgcaaagtggggtcccatcaaggttcagtggcagtggatctgggacagatttcactctcactgtcagcagtctgcaatttgaagattttgcaacttactactgtcaacagagtttcagtatcccttggactttcggccaagggaccaaggtggaaatcaaacgaa

SEQ ID NO: 598563 - DNA, 510 bp, Homo sapiens
  misc_feature: HIJSMM301BN2SZ.48.78.H01.1.454.light.4.raw
agtatacatacacgaccggtgctcgatttagtgtgagtagtttgggtttgggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgttctcaacagacaccagtgacaatcatgcgattttcggcggagggaccaagctgaccgtcctgggtcagcccaaggctgccccctcggtcactctcgttccc

SEQ ID NO: 598564 - DNA, 510 bp, Homo sapiens; identical to SEQ ID NO: 556652
  misc_feature: HIJSMM301ELWHX.17.28.C06.1.454.light.4.raw

SEQ ID NO: 598565 - DNA, 498 bp, Homo sapiens; identical to SEQ ID NO: 553891
  misc_feature: HIJSMM301CHY03.3.33.C11.1.454.light.4.raw

SEQ ID NO: 598566 - DNA, 494 bp, Homo sapiens; identical to SEQ ID NO: 534994
  misc_feature: HIJSMM301EN6RE.27.78.H01.1.454.light.4.raw

SEQ ID NO: 598567 - DNA, 494 bp, Homo sapiens; identical to SEQ ID NO: 534992
  misc_feature: HIJSMM301DGJF0.9.1.A01.1.454.light.4.raw

SEQ ID NO: 598568 - DNA, 520 bp, Homo sapiens
  misc_feature: HIJSMM301D4VPI.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgtttcactttcggtcggaggggaccaagggtgggaccgttcaaaccggaaactacgtggctgcaccatctgtcttcatcttcccgccact

SEQ ID NO: 598569 - DNA, 512 bp, Homo sapiens
  misc_feature: HIJSMM301B5BTC.41.35.D02.1.454.light.4.raw
tctatactatcacgaccggtgctcgatttagcacacgatagttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggcccaacccactgtcactctcg

SEQ ID NO: 598570 - DNA, 515 bp, Homo sapiens
  misc_feature: HIJSMM301D2X9Q.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcgccacgggacgaacggtaggaagtcgaaacgaactagtggctgcaccatactgtcttctatcttccgccactctgact

SEQ ID NO: 598571 - DNA, 491 bp, Homo sapiens; identical to SEQ ID NO: 536211
  misc_feature: HIJSMM301BKFZS.16.53.E09.1.454.light.4.raw

SEQ ID NO: 598572 - DNA, 498 bp, Homo sapiens
  misc_feature: HIJSMM301D85WL.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtcggaaatcaaaacgaactgtggctgcacc

SEQ ID NO: 598573 - DNA, 512 bp, Homo sapiens; identical to SEQ ID NO: 558821
  misc_feature: HIJSMM301DNUQ8.7.34.D01.1.454.light.4.raw

SEQ ID NO: 598574 - DNA, 505 bp, Homo sapiens; identical to SEQ ID NO: 586297
  misc_feature: HIJSMM301A99KE.8.28.C06.1.454.light.4.raw

SEQ ID NO: 598575 - DNA, 498 bp, Homo sapiens
  misc_feature: HIJSMM301AVHE2.52.34.D01.1.454.light.4.raw
cgcagtacgacacgaccggtgctcgatttagatcgtctgtgttgggtttgggggagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacggtatccctgatcgcttctcaggctccggctcgtgggactgagcgctacctcaccatctccagcctccagtctgaggacgagggtgactattactgtcaggacgtgggacactggcagttttgggtgtttcgggcggagggaccaaggttgaccggtcctaggtcagcccaaggctgccccccg

SEQ ID NO: 598576 - DNA, 497 bp, Homo sapiens
  misc_feature: HIJSMM301B0E41.26.80.H03.1.454.light.4.raw
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagtttttaccctcacaactcatatcacagaatctgaggatgctgcattttacttcggtctacaacatgataatttccctccgtggacgttcggccaagggaccaaggagcaaatcaaacgaactgtggctgcaccatctgtctttatcttcccgccat

SEQ ID NO: 598577 - DNA, 520 bp, Homo sapiens; identical to SEQ ID NO: 559743
  misc_feature: HIJSMM301DWY7U.27.23.C01.1.454.light.4.raw

SEQ ID NO: 598578 - DNA, 444 bp, Homo sapiens
  misc_feature: HIJSMM301D0Y5T.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctgttcccaccctcctccgtgtatgat

SEQ ID NO: 598579 - DNA, 498 bp, Homo sapiens
  misc_feature: HIJSMM301CS2GF.53.33.C11.1.454.light.4.raw
cgcgtatacacacgaccggtgctcgatttagagtgagctcgttgggtttgggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaagaaatatgcttattggtaccagcagaggtcaggccaggcccctgtgctggtcatctatgaggacaccaaacgaccctccgggatccctgcgagattctctggcgccagctcagggacagtggccaccctgacagtcagtgggcccaggtggaggatgaagctgattactactgttactcaacagacaggagtggaaatcatagggtattcggcggagggaccaaactgaccgtcctaggtcagcccaaggctgcccctcggtcta

SEQ ID NO: 598580 - DNA, 475 bp, Homo sapiens; identical to SEQ ID NO: 537714
  misc_feature: HIJSMM301BAHWI.7.81.H04.1.454.light.4.raw

SEQ ID NO: 598581 - DNA, 484 bp, Homo sapiens
  misc_feature: HIJSMM301DITPR.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcacttttcggcggagggaccagggtggagatcagacgaa

SEQ ID NO: 598582 - DNA, 505 bp, Homo sapiens; identical to SEQ ID NO: 547532
  misc_feature: HIJSMM301BRZJ7.8.1.A01.1.454.light.4.raw

SEQ ID NO: 598583 - DNA, 494 bp, Homo sapiens; identical to SEQ ID NO: 534994
  misc_feature: HIJSMM301BUGNX.27.78.H01.1.454.light.4.raw

SEQ ID NO: 598584 - DNA, 488 bp, Homo sapiens
  misc_feature: HIJSMM301B4RRR.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtgagggaccaaggtggaggtcaagaactgtggctgcaccatctgtcttcatt

SEQ ID NO: 598585 - DNA, 504 bp, Homo sapiens
  misc_feature: HIJSMM301DTFJO.21.22.B11.1.454.light.4.raw
  modified_base (431)..(431): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctggggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacggggacncaacatgggatgacaatctgagcggttgggtgtttggcggagggaccaaactgaccgtcctaggtcagcccaa

SEQ ID NO: 598586 - DNA, 489 bp, Homo sapiens
  misc_feature: HIJSMM301BXEK1.12.27.C05.1.454.light.4.raw
atacgacgtacacgaccggtgctcgatttagacgcgatcgaagggtttggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacggccaacatcacctgctctggagataaattggggcataaatatgtctgctggtatcaacagaaggcaggccagtcccctgtggttatcatctatcaagataacaagcggccctcagggatccctgagcgattctctggctccaactctgggaacacagccactctgaccatcagcgggacccaggctatggatgaggctgactattactgtcaggcgagggacagcagtactgcggtattcggcggagggaccaaagctgacgtcctaggtcagcccaaggctgcccctcggt

SEQ ID NO: 598587 - DNA, 460 bp, Homo sapiens
  misc_feature: HIJSMM301BN1DS.52.49.E05.1.454.light.4.raw
cgcagtacgacacgaccggtgctcgatttagagcgactagcaacacacaaaggggagtctcagtcaggacacagcatggacatgagggtccccgctcagctcctggggctcctgctactctggctccgaggtgccagatgtgacatccagatgacccagtctccatcctccctgtctgcatctgtaggagacgaagtcaccatgacttgccgggcaagtcagagcattagcagccatttgaattggtatcagcagaaacctgggaaagcccctcagctcctgatctttgctgcatccagtttgcacagtggggtcccatcaaggttcagtggcagtggatctgggacagacttcactctcaccatcagcagtctgcaacctgaggattttgccacttactactgtcaacagacttacaatacccctccatacacttttggccagggaccaagctggagat

SEQ ID NO: 598588 - DNA, 500 bp, Homo sapiens; identical to SEQ ID NO: 547405
  misc_feature: HIJSMM301E02D7.41.71.G05.1.454.light.4.raw

SEQ ID NO: 598589 - DNA, 503 bp, Homo sapiens; identical to SEQ ID NO: 551625
  misc_feature: HIJSMM301CCOVW.10.71.G05.1.454.light.4.raw

SEQ ID NO: 598590 - DNA, 515 bp, Homo sapiens
  misc_feature: HIJSMM301CGIFI.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctcgggaccgaaacgtaggagtaatacaaacgaaactagtggtctcgcaccatctgtt

SEQ ID NO: 598591 - DNA, 498 bp, Homo sapiens
  misc_feature: HIJSMM301EH508.40.67.G01.1.454.light.4.raw
tctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcctcccacagggccactggcatcccacacaggttcagtggcagtgggtctgggacagacttcagtctcaccatcagcagcctagagcctgaggattttgcaatttatttctgtcaacagcgtagcacctggccccgggtcaccttcggccaaggacacgactggacatgaaacgaactgtggctgcaccatctgtcttcat

SEQ ID NO: 598592 - DNA, 510 bp, Homo sapiens
  misc_feature: HIJSMM301CFCQL.12.53.E09.1.454.light.4.raw
atacgacgtacacgaccggtgctcgatttagagagagtgtgttgggtttgggggctggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctggtcagcccaaggctgccccctcc

SEQ ID NO: 598593 - DNA, 484 bp, Homo sapiens
  misc_feature: HIJSMM301CZV70.41.34.D01.1.454.light.4.raw
  modified_base (464)..(464): a, c, t, g, unknown or other
  modified_base (473)..(473): a, c, t, g, unknown or other
tctatactatcacgaccggtgctcgatttagatcgtctgtgttgggtttggggggagtcaggcccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtcccatcaaggtttagcggcagtggatctgggacagaattcactctcacgatcagcggcctgcagcctgatgatgtcgcaacttattactgccaacactatgatagttacccgctcactttcggcggagggaccgaaggtggaggtnaagcgaacngtggctgcaca

SEQ ID NO: 598594 - DNA, 497 bp, Homo sapiens
  misc_feature: HIJSMM301EGV4W.40.11.A11.1.454.light.4.raw
tctagcgactcacgaccggtgctcgatttagctacgactgcagggaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtcttttatacaactccaacaagcagcactacttagcttggtaccagcagaaaccaggacagcctcctaaactgctcatttactgggcctctacccgggaatccggggtccctgaccgattcagtggcagcgggtctgggacagatttcactctgaccatcagcagcctgcaggctgaagatgtggcagtttattactgtcaacaatattatattattccgaggacgttcggccaagggaccaaggtggaaatcaaaacgaactgtggctgcaccatctgtcttcatcttcccgccat

SEQ ID NO: 598595 - DNA, 502 bp, Homo sapiens; identical to SEQ ID NO: 541971
  misc_feature: HIJSMM301AQXLR.4.39.D06.1.454.light.4.raw

SEQ ID NO: 598596 - DNA, 474 bp, Homo sapiens; identical to SEQ ID NO: 561309
  misc_feature: HIJSMM301DFGX0.5.12.B01.1.454.light.4.raw

SEQ ID NO: 598597 - DNA, 444 bp, Homo sapiens; identical to SEQ ID NO: 535856
  misc_feature: HIJSMM301BDGHL.9.9.A09.1.454.light.4.raw

SEQ ID NO: 598598 - DNA, 518 bp, Homo sapiens
  misc_feature: HIJSMM301CUVJR.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaacccactgtcactctgttcccaccctcctccgtgt

SEQ ID NO: 598599 - DNA, 501 bp, Homo sapiens
  misc_feature: HIJSMM301DOGZ1.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcacttcggtcaaggacacgactggagattaaacg

SEQ ID NO: 598600 - DNA, 448 bp, Homo sapiens
  misc_feature: HIJSMM301DIPU3.40.14.B03.1.454.light.4.raw
tctagcgactcacgaccggtgctcgatttagtgtgagtagttccgcggggcagcttcagctgtgggtagagaagacaggactcaggacaatctccagcatggccagcttccctctcctcctcaccctcctcactcactgtgcagggtcctgggcccagtctgtcctgactcagccaccctcagcgtctgggacccccgggcagggggtcatgatctcttgtttggaagtagctccaacatcggaagtaataatgtgaactggtctggcacctcagcctccctggccatcattgatctccagtctgaggatgaggctgactattactgttcagcatgggatgccagcctgaatgtctgggtgttcggcggagggaccaagttgaccgtcctaggtcagcccaaggctgccccctcggtcactctgttcccaccctcctcagtcgctaga

SEQ ID NO: 598601 - DNA, 504 bp, Homo sapiens
  misc_feature: HIJSMM301BQ7YG.5.24.C02.1.454.light.4.raw
atcagacacgcacgaccggtgctcgatttagtacagatcgttagggaaagggggctggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaaggctgaccgtcctaggtcagcccaaggccg

SEQ ID NO: 598602 - DNA, 493 bp, Homo sapiens; identical to SEQ ID NO: 581279
  misc_feature: HIJSMM301BKNT9.9.75.G09.1.454.light.4.raw

SEQ ID NO: 598603 - DNA, 526 bp, Homo sapiens
  misc_feature: HIJSMM301AE1X4.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccgaacggaccgaacggtaggaaggtacaaacgaaactagtaggtcgtcggcaccactctcgtcttctatcttcccgtccactct

SEQ ID NO: 598604 - DNA, 485 bp, Homo sapiens; identical to SEQ ID NO: 536695
  misc_feature: HIJSMM301CK7H5.10.1.A01.1.454.light.4.raw

SEQ ID NO: 598605 - DNA, 463 bp, Homo sapiens
  misc_feature: HIJSMM301C9DEE.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccaaaatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaaggctgccccctcggtcactctgttcccaccctcctcacgcgtatgt

SEQ ID NO: 598606 - DNA, 494 bp, Homo sapiens
  misc_feature: HIJSMM301D38V2.27.78.H01.1.454.light.4.raw
agcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttatactgtcatcagagtactactttacctcaagtgatcaccttcggccaagggacacgactggagattaaacgaactgtggctgcaccatctgtt

SEQ ID NO: 598607 - DNA, 500 bp, Homo sapiens; identical to SEQ ID NO: 541872
  misc_feature: HIJSMM301AL26Z.48.82.H05.1.454.light.4.raw

SEQ ID NO: 598608 - DNA, 496 bp, Homo sapiens; identical to SEQ ID NO: 563949
  misc_feature: HIJSMM301B9UH8.7.31.C09.1.454.light.4.raw

SEQ ID NO: 598609 - DNA, 506 bp, Homo sapiens
  misc_feature: HIJSMM301DKEMI.3.79.H02.1.454.light.4.raw
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggtattggtggagggaccaagctgaccgtcctaggtcagcccaaggctgccccctcggt

SEQ ID NO: 598610 - DNA, 500 bp, Homo sapiens; identical to SEQ ID NO: 541228
  misc_feature: HIJSMM301BFZSO.13.11.A11.1.454.light.4.raw

SEQ ID NO: 598611 - DNA, 502 bp, Homo sapiens
  misc_feature: HIJSMM301BBRR6.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccgaagctggaggatcaaacgaaacgtgtggctgcaccactctgtt

SEQ ID NO: 598612 - DNA, 494 bp, Homo sapiens
  misc_feature: HIJSMM301BIFPQ.17.40.D07.1.454.light.4.raw
cgtagactagcacgaccggtgctcgatttagtgatagagcgtaacaacagagggggtggtagctcaggaagcagagcctggagcatctccactatggcctgggctccactacttctcaccctcctcgctcactgcacaggttcttgggccaactttatgctgactcagcccctctctgtgtcggggtctccggggaagacaataaccatctcctgcacccgcagcagtggcaacattggcagccaatatgtgcagtggtaccagcagcgcccgggcagttcccctagaactgtgatctatgaagatactgtcagaccctccgggatccctgatcggttctctggctccgtcgacagttcctccaactctgcctccctcaccatctctggactgacgactgaggacgagggtgactactactgtcactcttatgatgacatttatgaggcgatattcggcggagggacaaaggtgaccgtgctaggtcagacccg

SEQ ID NO: 598613 - DNA, 492 bp, Homo sapiens
  misc_feature: HIJSMM301C6IRJ.11.81.H04.1.454.light.4.raw
cgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttttactgtcagcagtatagtaactggcctccgtacacttttggccaggggaccaagctagaaatcaaacgaactgtgctgcaccatctgtcttca

SEQ ID NO: 598614 - DNA, 510 bp, Homo sapiens
  misc_feature: HIJSMM301C9USJ.5.60.F05.1.454.light.4.raw
atcagacacgcacgaccggtgctcgatttagtacgtcatcagggaaagggggcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcacctcagcctccctggccatccgtgggctccagtctgaggatgagtctgattattactgtgcaacatgggatgacagcctgaatggtccggtattcggcggaggaccgaagctgaccgtcctcggtcagcccaaggctgccccctcggt

SEQ ID NO: 598615 - DNA, 523 bp, Homo sapiens
  misc_feature: HIJSMM301DF7YO.49.35.D02.1.454.light.4.raw
agtcgagagacacgaccggtgctcgatttagcacacgatagttgggtttgggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaatatgcttgttggtaccagaagaagtcaggccaggccccggtgttgctcatctatgacgacagaaaacgaccctccgggatccctgagagattctctggctccacctcagggaccatggccacgttgactatcagccggggcccaggtggaggatgaaggtgactactattgttactcaccagacaccagtgaaaatcaacagaggaatattcggcggagggaccaagctgaccgtcctaggtcagcccaaggctcgccccctcggtcactctcgttcccaccctcct

SEQ ID NO: 598616 - DNA, 515 bp, Homo sapiens; identical to SEQ ID NO: 541455
  misc_feature: HIJSMM301DQFWU.17.33.C11.1.454.light.4.raw

SEQ ID NO: 598617 - DNA, 505 bp, Homo sapiens
  misc_feature: HIJSMM301D679K.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaaacaataaacaactacttagcttggtaccagcagaaaccaggacagccccctaaggtcctcatttactgggcatctacccgggagtccggggtccctgaccgattcagaggcagcgggtctgggacagatttcactctcaccatcaccaaacctgcaaggctgaagatgtggcagtttattactgtcagcaaatactatagtcctcctctcacgttcggcggagggaccaaggtgagatcaaaagaactgtggctgcaccatctgtctt

SEQ ID NO: 598618 - DNA, 483 bp, Homo sapiens; identical to SEQ ID NO: 545057
  misc_feature: HIJSMM301DBYJX.48.37.D04.1.454.light.4.raw

SEQ ID NO: 598619 - DNA, 510 bp, Homo sapiens; identical to SEQ ID NO: 538614
  misc_feature: HIJSMM301CPVGA.19.59.F04.1.454.light.4.raw

SEQ ID NO: 598620 - DNA, 487 bp, Homo sapiens
  misc_feature: HIJSMM301BA23L.5.40.D07.1.454.light.4.raw
atcagacacgcacgaccggtgctcgatttagtgatagagcgtaacaacagaggggggaactgctcagttaggacccagacggaaccatggaagccccagcgcagcttctcttcctcctgctactctggctcccagataccattggagagatagtgatgacgcagtctccagccaccctgtctgtgtctccaggggaaagagccaccctctcctgcagggccagccagagtgtaagtagtaggttagcctggtatcagcagaaacctggccaggctcccaggctcctcatctatggtgcatctaccagggccactggtatcccagccaggttcagtggcagtgggtctgggacagagttcactctcaccatcagcagcctgcagtctgaagattttgctagtttattactgtcaacagtataatgactggtggacgttcggccaagggaccaaggtggagaccgaaacgaactgtggctgcaccatct

SEQ ID NO: 598621 - DNA, 476 bp, Homo sapiens; identical to SEQ ID NO: 538611
  misc_feature: HIJSMM301AS8E4.7.81.H04.1.454.light.4.raw

SEQ ID NO: 598622 - DNA, 493 bp, Homo sapiens
  misc_feature: HIJSMM301C9CXL.12.71.G05.1.454.light.4.raw
atacgacgtacacgaccggtgctcgatttagtgtcgtcgcaagagagaggggggggtcgacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgctgggagtgataagtttgtctcctggtaccaacatcacccaggcaaagcccccagactcatgatttatgagggacaaaaaacggccctcggggatttctaatcgcttctctggctccaagtctggcaacacggcctccctgacaatctctgggctccagggctgaggacgaggctgattattactgctgctcatatgcaggtagtggcacttttcgcactattcggcggagggaccaagctgaccgtcctacgtcagccc

SEQ ID NO: 598623 - DNA, 471 bp, Homo sapiens
  misc_feature: HIJSMM301C4EDP.49.73.G07.1.454.light.4.raw
agtcgagagacacgaccggtgctcgatttagctctacgctcaggggcaggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcgtgtatctgaattggtatcagcaaaaccagggaaagcccctgagctcctgatcctcgatgcatccaatttggaaacaggggtcccatcgaggttctctggaagtggctctgggacacattttactttcaccatcagcagactgcagcctgaagatattgcaacatattactgtcaacagtatagataatctcccgctcactttcggcggagggaccaaggtggagatcaaacgaactgtgg

SEQ ID NO: 598624 - DNA, 504 bp, Homo sapiens
  misc_feature: HIJSMM301EP262.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcttggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggactgggaccaagatcaccgtcctaggtcagcccaaggcccaaccccactgtcta

SEQ ID NO: 598625 - DNA, 520 bp, Homo sapiens; identical to SEQ ID NO: 539176
  misc_feature: HIJSMM301DVFTS.27.23.C01.1.454.light.4.raw

SEQ ID NO: 598626 - DNA, 488 bp, Homo sapiens; identical to SEQ ID NO: 545628
  misc_feature: HIJSMM301B0R49.14.55.E11.1.454.light.4.raw

SEQ ID NO: 598627 - DNA, 504 bp, Homo sapiens; identical to SEQ ID NO: 535077
  misc_feature: HIJSMM301DNW6L.8.28.C06.1.454.light.4.raw

SEQ ID NO: 598628 - DNA, 488 bp, Homo sapiens
  misc_feature: HIJSMM301AOKIE.21.55.E11.1.454.light.4.raw
tcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattatttgccggacaagtcacgacataaacacctttttaaattggtatcagcacaaaccagggaaggccccaaagctcctgatcgatgctgcatccaatttagagagtggggtcccatccaggttcagtggcgatggatctgggacaaatttcactctcaccatcagcagtctgcaacctgaagattttgcaactttactattgtcaacagagttacagtattcctttcactttcggccctgggaccgaagtcgatatcaaacgaactgtggctgcaccatctgt

SEQ ID NO: 598629 - DNA, 501 bp, Homo sapiens; identical to SEQ ID NO: 536142
  misc_feature: HIJSMM301DATZ6.15.1.A01.1.454.light.4.raw

SEQ ID NO: 598630 - DNA, 511 bp, Homo sapiens
  misc_feature: HIJSMM301B0VVK.19.59.F04.1.454.light.4.raw
tactctcgtgcacgaccggtgctcgatttagtacacacacttagggattggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaattttgtgtcctggtaccagcagctcccaggaacagcccccaaactcctcatttttgacaataataagcgaccctcagggattcctgaccgattctctggctccaagtctggcacgtcagccaccctgggcatcaccggactccagactggggacgaggccgattattactgcggaacatgggatagcagcctgagtactgtgataatcggcggagggaccaagctgaccgtcctaggtcagccccaaggctgccccctcggtccactctgttcccg

SEQ ID NO: 598631 - DNA, 497 bp, Homo sapiens
  misc_feature: HIJSMM301DNG45.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtgggtcccatcaaggttcagcggcagtgaaactgggacagaattcattctcaccatcagcagcctgcagcctgatgattttgcaacttattactgccaacagtataagagttatccgtggacgttcggccaagggaccagggtggaaagtacaaacgaaactgtggctgcaccatctgtcttcatt

SEQ ID NO: 598632 - DNA, 494 bp, Homo sapiens
  misc_feature: HIJSMM301B0IBV.48.4.A04.1.454.light.4.raw
agtatacatacacgaccggtgctcgatttagagtagtgatcagggggagtcagtctcagtcaggacacagcatggacatgagggtccccgctcagctcctggggctcctgctactctggctccgaggtgccagatgtgacatccagatgacccagtctccatcatccctgtctgcatatgtgggggacagagtcaccatcacttgccgggcaagtcagagcattagtaggtatttaaattggtatcatcaaagaccagggatggcccctaacctcctgatctacggtacatccactttgcaaagtggggtcccctcaaggttcagcggcagtggctcttggacggatttcactctcaccatcaccagtcttcaggctgaagatttaggaatttactactgtcagcagacttacagtgttccgtacacttttggccagggaccaaactggagatgaaacgaactgtggctgcaccatctgtcttcatcttccccg

SEQ ID NO: 598633 - DNA, 460 bp, Homo sapiens; identical to SEQ ID NO: 536053
  misc_feature: HIJSMM301A3QW3.22.28.C06.1.454.light.4.raw

SEQ ID NO: 598634 - DNA, 485 bp, Homo sapiens; identical to SEQ ID NO: 536263
  misc_feature: HIJSMM301DBJOT.47.78.H01.1.454.light.4.raw

SEQ ID NO: 598635 - DNA, 383 bp, Homo sapiens; identical to SEQ ID NO: 447524
  misc_feature: HIJSMM301CD210.41.26.C04.1.454.light.4.raw

SEQ ID NO: 598636 - DNA, 501 bp, Homo sapiens; identical to SEQ ID NO: 536142
  misc_feature: HIJSMM301DI0SR.15.1.A01.1.454.light.4.raw

SEQ ID NO: 598637 - DNA, 495 bp, Homo sapiens
  misc_feature: HIJSMM301EOOCP.49.78.H01.1.454.light.4.raw
agtcgagagacacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataatgtccgggctccggacactttcggcggagggaccgaacggtggagatcaaacgaactagtggcgtgcaccatct

SEQ ID NO: 598638 - DNA, 501 bp, Homo sapiens; identical to SEQ ID NO: 536142
  misc_feature: HIJSMM301ENL7W.15.1.A01.1.454.light.4.raw

SEQ ID NO: 598639 - DNA, 486 bp, Homo sapiens
  misc_feature: HIJSMM301DZSK4.40.69.G03.1.454.light.4.raw
tctagcgactcacgaccggtgctcgatttagtcgctgcgtaaaggagaaagggggaggaactgctcagttaggacccagacggaaccatggaagccccagcgcagcttctcttcctcctgctactctggctcccagatagcgctggagaaatagtgatgacgcagtctccagccaccctgtctgtgtctccagggaaaagagccaccctctcctgcagggccagtgagagtgttgacacctacttagcctggtaccaacacagacctggccaggctcccaggctcctcatctatgatgcatccagcagggccactggcatcccagccaggttcagtggcagtgggtctgggacagacttcactctcaccatcagcggcctagagcctgaagactttgcagtttattactgtcagcagcgtaccaactggccgctcactttcggcggagggaccaagggtggagatcaaacgaactgtggctgcacc

SEQ ID NO: 598640 - DNA, 492 bp, Homo sapiens; identical to SEQ ID NO: 535126
  misc_feature: HIJSMM301AUETP.18.11.A11.1.454.light.4.raw

SEQ ID NO: 598641 - DNA, 483 bp, Homo sapiens
  misc_feature: HIJSMM301CZFI1.40.10.A10.1.454.light.4.raw
tctagcgactcacgaccggtgctcgatttagcgtcgatctcagggggcaggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggtacgttcggtccacggggaccaaaaggttacggaagtgttcaaaccgtaaacct

SEQ ID NO: 598642 - DNA, 495 bp, Homo sapiens; identical to SEQ ID NO: 543631
  misc_feature: HIJSMM301DN7YI.11.59.F04.1.454.light.4.raw

SEQ ID NO: 598643 - DNA, 516 bp, Homo sapiens
  misc_feature: HIJSMM301BLO2B.43.59.F04.1.454.light.4.raw
tgtgagtagtcacgaccggtgctcgatttagtacacacacttagggattgggggcgccaggggtcccttccaatatcagcaccatggcctggactcctctctttctgttcctcctcacttgctgcccagggtccaattctcagactgtggtgagggaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcggggcaaagctgccctgacactgtcaggtgtgcagcctgaggacgaggctgactattactgcctgctcatatatggtggcgcgtgggtgttcggcggagggaccaagctgaccgtcctgggtcagcccaaggctgccccctggtcactctgttcccaccctcctcacta

SEQ ID NO: 598644 - DNA, 490 bp, Homo sapiens; identical to SEQ ID NO: 538273
  misc_feature: HIJSMM301EETE4.16.73.G07.1.454.light.4.raw

SEQ ID NO: 598645 - DNA, 505 bp, Homo sapiens
  misc_feature: HIJSMM301DL4M7.48.77.G11.1.454.light.4.raw
agtatacatacacgaccggtgctcgatttagctagtcactcaagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcggggtccctgatcgcttctctggctccaagtctggcaacacggcctccctgaccatctctgggctccaggctgaagatcaggctgattattactgctgttcattttcaagttcctttttgtcttcggaactggaccgaggtcaccgtcctaggtcagcccaaggccaaccccactgtcact

SEQ ID NO: 598646 - DNA, 504 bp, Homo sapiens
  misc_feature: HIJSMM301DXV28.18.26.C04.1.454.light.4.raw
tacgagtatgcacgaccggtgctcgatttagtctagcgactttgggtttgggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccgaaggtagagatacaaaggaactgtggctgcaccatctgtcttcatcttcccgccta

SEQ ID NO: 598647 - DNA, 505 bp, Homo sapiens
  misc_feature: HIJSMM301EKW0A.19.78.H01.1.454.light.4.raw
tactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaacgcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaacccactgtcta

SEQ ID NO: 598648 - DNA, 504 bp, Homo sapiens; identical to SEQ ID NO: 537401
  misc_feature: HIJSMM301C5TOX.51.23.C01.1.454.light.4.raw

SEQ ID NO: 598649 - DNA, 517 bp, Homo sapiens; identical to SEQ ID NO: 541955
  misc_feature: HIJSMM301BMSAC.22.30.C08.1.454.light.4.raw

SEQ ID NO: 598650 - DNA, 493 bp, Homo sapiens
  misc_feature: HIJSMM301C5GWS.41.27.C05.1.454.light.4.raw
tctatactatcacgaccggtgctcgatttagacgcgatcgaagggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctcctgaccatctctgggctccaggctgaggacgaggctgattattactgcagctcatatacaagcagcagcactctcgtggtattcggcggagggaccaaggctgaccgtcctaggtcagcccaaagg

SEQ ID NO: 598651 - DNA, 516 bp, Homo sapiens
  misc_feature: HIJSMM301CF7X4.7.34.D01.1.454.light.4.raw
cgtgtctctacacgaccggtgctcgatttagatcgtctgtgttgggtttggggggggtctcaggaggcagcgctctcgggacgtctccaccatggcctgggctctgctattcctctccctcctcactcagggcacagggtcctgggcccagtctaccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacagcattatttgggtgttcggcggagggaccaagctgaccgtcctgcgtcagcccaaggctcgccccctcggtcactctcg

SEQ ID NO: 598652 - DNA, 447 bp, Homo sapiens; identical to SEQ ID NO: 535201
  misc_feature: HIJSMM301ECDKO.18.9.A09.1.454.light.4.raw

SEQ ID NO: 598653 - DNA, 485 bp, Homo sapiens; identical to SEQ ID NO: 535688
  misc_feature: HIJSMM301BFC25.19.5.A05.1.454.light.4.raw

SEQ ID NO: 598654 - DNA, 501 bp, Homo sapiens; identical to SEQ ID NO: 555551
  misc_feature: HIJSMM301ANZIW.21.81.H04.1.454.light.4.raw

SEQ ID NO: 598655 - DNA, 475 bp, Homo sapiens; identical to SEQ ID NO: 570411
  misc_feature: HIJSMM301CURS8.13.39.D06.1.454.light.4.raw

SEQ ID NO: 598656 - DNA, 521 bp, Homo sapiens; identical to SEQ ID NO: 539470
  misc_feature: HIJSMM301CL4P1.27.23.C01.1.454.light.4.raw

SEQ ID NO: 598657 - DNA, 504 bp, Homo sapiens; identical to SEQ ID NO: 535561
  misc_feature: HIJSMM301AFI7J.4.57.F02.1.454.light.4.raw

SEQ ID NO: 598658 - DNA, 447 bp, Homo sapiens
  misc_feature: HIJSMM301DP9EF.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagtccaaggccaacccctctgtcactctgttcccaccctcctccatactcgta

SEQ ID NO: 598659 - DNA, 496 bp, Homo sapiens
  misc_feature: HIJSMM301CFRR1.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtcctaggtcagcccaaggccg

SEQ ID NO: 598660 - DNA, 511 bp, Homo sapiens
  misc_feature: HIJSMM301DGDTU.17.62.F07.1.454.light.4.raw
cgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgaccctttcggtgcgcagcctgaggatgaggctgagtattactgcttgctctcctatagttggtgttcgggtgttcggcggagggaccaagctgaccgtcctaggtcagccaaggctgcccctcggtcactctgttcccaccctcctcctagtctacg

SEQ ID NO: 598661 - DNA, 515 bp, Homo sapiens
  misc_feature: HIJSMM301EVPW4.7.34.D01.1.454.light.4.raw
cgtgtctctacacgaccggtgctcgatttagatcgtctgtgttgggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacagcattatttgggtggttcggcggagggaccaagctgaccgtcctgcgtcagcccaaggctcgccccctcggtccactc

SEQ ID NO: 598662 - DNA, 493 bp, Homo sapiens; identical to SEQ ID NO: 536007
  misc_feature: HIJSMM301DIPYG.27.78.H01.1.454.light.4.raw

SEQ ID NO: 598663 - DNA, 502 bp, Homo sapiens
  misc_feature: HIJSMM301EV9MO.11.81.H04.1.454.light.4.raw
cgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtactcccagccaggttcagtggcagtgggtctgggacagagttcactctcaccatcagcagcctgcagtctgaagattttgctagtttttactgtcagcagtatagtaactggcctccgtactacttttggccaggggaccaacgactagaaatacaaacgaactacgtggctgcaccactctgtcttcta

SEQ ID NO: 598664 - DNA, 505 bp, Homo sapiens
  misc_feature: HIJSMM301EGB2Z.41.35.D02.1.454.light.4.raw
tctatactatcacgaccggtgctcgatttagcacacgatagttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctgatcgcttctctggctccaagtctggcaatacggcctccctgacagtctctcggctccaggcggaggacgaggctgattactactgcttctcatatgcagatactaagtcctgggtgttcggcggagggaccaagctgaccgtcctaggtcagcccaaggctcgccccctcggt

SEQ ID NO: 598665 - DNA, 503 bp, Homo sapiens
  misc_feature: HIJSMM301EV5MW.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctccccggacgtcgtcaggacgaacgaggaatacaagacgaactagtaggctgcaccactctgtcttctactcttcccgt

SEQ ID NO: 598666 - DNA, 499 bp, Homo sapiens
  misc_feature: HIJSMM301AROL7.41.53.E09.1.454.light.4.raw
tctatactatcacgaccggtgctcgatttagagagagtgtgttgggtttgggggggtcgtcgaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctcctgaccatctctgggctccaggctgaggacgaggctgattattactgcagctcatatacaagcagcagcactctcgtggtattcgggcggagggaccaaggctgaccgtctaggtcagcccaaggctcg

SEQ ID NO: 598667 - DNA, 505 bp, Homo sapiens
  misc_feature: HIJSMM301BM54R.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcggcggagggaccaagctgaccgtcctaggtcagcccaaggctcgccccccg

SEQ ID NO: 598668 - DNA, 492 bp, Homo sapiens
  misc_feature: HIJSMM301ESE2V.3.33.C11.1.454.light.4.raw
agacgcactccacgaccggtgctcgatttagagtgagctcgttgggtttggggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcgggcggagggaccaagctgaccgtcctaggtcagcccaaggct

SEQ ID NO: 598669 - DNA, 494 bp, Homo sapiens; identical to SEQ ID NO: 534992
  misc_feature: HIJSMM301E4G41.9.1.A01.1.454.light.4.raw

SEQ ID NO: 598670 - DNA, 502 bp, Homo sapiens
  misc_feature: HIJSMM301EUH5L.40.33.C11.1.454.light.4.raw
tctagcgactcacgaccggtgctcgatttagagtgagctcgttgggtttgggcacgaccggtgctcgatttagagtgagctcgttgggtttggggggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatgtggggggtgccacttgggtgttcggcggac

SEQ ID NO: 598671 - DNA, 495 bp, Homo sapiens; identical to SEQ ID NO: 538920
  misc_feature: HIJSMM301C8UBY.47.64.F09.1.454.light.4.raw

SEQ ID NO: 598672 - DNA, 496 bp, Homo sapiens; identical to SEQ ID NO: 535109
  misc_feature: HIJSMM301EM1GT.16.78.H01.1.454.light.4.raw

SEQ ID NO: 598673 - DNA, 500 bp, Homo sapiens; identical to SEQ ID NO: 540219
  misc_feature: HIJSMM301BGT3D.43.34.D01.1.454.light.4.raw

SEQ ID NO: 598674 - DNA, 496 bp, Homo sapiens; identical to SEQ ID NO: 536802
  misc_feature: HIJSMM301DJWJM.5.24.C02.1.454.light.4.raw

SEQ ID NO: 598675 - DNA, 487 bp, Homo sapiens; identical to SEQ ID NO: 536206
  misc_feature: HIJSMM301DNVCY.47.38.D05.1.454.light.4.raw

SEQ ID NO: 598676 - DNA, 496 bp, Homo sapiens
  misc_feature: HIJSMM301CY2NJ.14.59.F04.1.454.light.4.raw
  modified_base (483)..(483): a, c, t, g, unknown or other
cgtctagtaccacgaccggtgctcgatttagtacacacacttagggattgggggatcaggactcctcagttcaccttctcacaatgaggctccctgctcagctcctggggctgctaatgctctgggtctctggatccagtggggatattgtgatgactcagtctccactttccctgaccgtcacccctggagagccggcctccatctcctgcaggtctagtcagagcctcctgcatactaatggaaacaactttttggattggtacctgcagaagccagggcagtctccacagctcctgatctatttgggttctaatcgggcctccggagtccctgacaggttcagtggcagtggatcaggcacagattttacactgaaaatcagcagagtggaggctgaggatgttggggtttatactgcatgcaagctctacaaactcgaacgttcggccaagggaccaaggtggaaatcaaacgaactgnggctgcaccatct

SEQ ID NO: 598677 - DNA, 467 bp, Homo sapiens
  misc_feature: HIJSMM301DPUT3.49.27.C05.1.454.light.4.raw
agtcgagagacacgaccggtgctcgatttagacgcgatcgaagggtttggggagtcagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcatcacctactatttaaattggtatcagcaaaacccagggaaagcccctaagctcctgatctatgctgcatccaatctgcaaagtggggtcccatcaaggttcagtggcagtggatctgggacagatttcaccctcaccatcagcagtctgcaacctgatgattttgcaacttattattgtcaacagagttacagtatcccgtactacttttggccagggaccaggctggatatcagacgaa

SEQ ID NO: 598678 - DNA, 496 bp, Homo sapiens; identical to SEQ ID NO: 535541
  misc_feature: HIJSMM301BJ6M0.3.33.C11.1.454.light.4.raw

SEQ ID NO: 598679 - DNA, 491 bp, Homo sapiens
  misc_feature: HIJSMM301C3ZBE.52.85.H08.1.454.light.4.raw
cgcagtacgacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgacctgactcagccaccctcagtgtccgtgtctccaggacagacagccaccatcacctgctctggagataaattggggggaaaatatgcttgctggtatcaacagcggccaggccagtcccctgtactggtcatctatctgaatagtaggcggccctctgggatccctgaccgattctctggctcccactctgggaacacagccactctgaccatcagcgggacccaggctttggatgaggctgactattactgtcaggcgtgggacaccatcactggagtaatattcggcggagggaccaggctgaccgtcctaggtcagcccaaggctcgccccctcggt

SEQ ID NO: 598680 - DNA, 508 bp, Homo sapiens
  misc_feature: HIJSMM301C8ZMA.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgttcggtccacgggaccgacacgtagaaatagagacgaactagtggctgcaccatctgtcttctactcttcccgt

SEQ ID NO: 598681 - DNA, 494 bp, Homo sapiens; identical to SEQ ID NO: 571133
  misc_feature: HIJSMM301A6FW0.49.66.F11.1.454.light.4.raw

SEQ ID NO: 598682 - DNA, 504 bp, Homo sapiens
  misc_feature: HIJSMM301A27LW.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctgccccctc

SEQ ID NO: 598683 - DNA, 508 bp, Homo sapiens; identical to SEQ ID NO: 537871
  misc_feature: HIJSMM301DPNMI.8.33.C11.1.454.light.4.raw

SEQ ID NO: 598684 - DNA, 494 bp, Homo sapiens; identical to SEQ ID NO: 535276
  misc_feature: HIJSMM301BGFDX.16.6.A06.1.454.light.4.raw

SEQ ID NO: 598685 - DNA, 514 bp, Homo sapiens
  misc_feature: HIJSMM301A0MTI.51.1.A01.1.454.light.4.raw
cgatcgtatacacgaccggtgctcgatttagacgtctcatcagggaaaggggagagaagacaggattcaggacaatctccagcatggccggcttccctctcctcctcaccctccgcactcactgtgcagggtcctgggcccagtctgtactgactcagccaccctcagcgtctgggacccccgggcagagggtcaccatctcttgttctggaagcagctgccatatcgaaaataattctgaatactggtaccatcacctcccaggaacggcccccaaattcctcattgataggaataatcagcggccctcaggggtcccggaccgattctctggctccaagtctggcacctcagcctccctggccatcagtgggctccggtccgaggatgagactgattattattgtgcaacatgggatgacagcctgagtggtcggaagtggcgttcggcggagggaccaagctgaccgtcctacgtcagcccaaggctgccccctcggtcactctgttcccg

SEQ ID NO: 598686 - DNA, 504 bp, Homo sapiens
  misc_feature: HIJSMM301D092R.48.15.B04.1.454.light.4.raw
agtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaaactactcatttactcggcatccacccggaagtccgaggttcctgaccgattccgtggcagcgggtctgggacagattttactctcaccatcactaccctgcaggctgaagatgtggcagtttatactgtcaacaatattattctactccgccgacgttcggccggggaccaacgtggaaatcaaacgaactgtggctgcaccatctgtcttc

SEQ ID NO: 598687 - DNA, 508 bp, Homo sapiens
  misc_feature: HIJSMM301CRH3Y.3.79.H02.1.454.light.4.raw
  modified_base (457)..(457): a, c, t, g, unknown or other
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggtatttggnggagggaccaagctgaccgtcctaggtcagcccaaggctgccccctcgtcc

SEQ ID NO: 598688 - DNA, 494 bp, Homo sapiens
  misc_feature: HIJSMM301C9ZW7.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccagggtggagatcaaacgaactgtggctgcaccatctgtcttcatcc

SEQ ID NO: 598689 - DNA, 513 bp, Homo sapiens
  misc_feature: HIJSMM301CTQQR.40.47.E03.1.454.light.4.raw
tctagcgactcacgaccggtgctcgatttagactcgcgcacagagagaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccaataatgacgttggtggttacaactatgtctcctggtaccaacaatacccaggcaaagcccccaaactcctgatttatgaggtcagtaagcggccctcaggggtccctgatcgcttctctggctccaagtctgtcaacacggcctccctgaccgtctctgggctccaggctgaggatgaggctgtttactactgcagctcatatgcaggcagcaataatttggtgttcggcgggggaccaagctgaccgtcctaggtcagcccaaggctcgcccctcggtcactcttccg

SEQ ID NO: 598690 - DNA, 508 bp, Homo sapiens
  misc_feature: HIJSMM301AD96D.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaactccactgtcactttcg

SEQ ID NO: 598691 - DNA, 490 bp, Homo sapiens; identical to SEQ ID NO: 575119
  misc_feature: HIJSMM301DAHMW.14.55.E11.1.454.light.4.raw

SEQ ID NO: 598692 - DNA, 502 bp, Homo sapiens
  misc_feature: HIJSMM301E0GFR.19.78.H01.1.454.light.4.raw
  modified_base (498)..(498): a, c, t, g, unknown or other
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcacgtcctaggtcagcccaaggccaaccccacngtca

SEQ ID NO: 598693 - DNA, 489 bp, Homo sapiens
  misc_feature: HIJSMM301EN5I1.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggactttcggcctggaccaagtgagatcaacgaactgtggctgcaccatctgtctt

SEQ ID NO: 598694 - DNA, 515 bp, Homo sapiens
  misc_feature: HIJSMM301BFHMQ.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctcggtcactctgttcccaccctccctcgagtagtaca

SEQ ID NO: 598695 - DNA, 513 bp, Homo sapiens
  misc_feature: HIJSMM301DQBMP.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgtcgtccgacgggaccgacacgtagaaatagagacgaacgtacgtggcgtgtcaccactctgtcttctactcttcccgt

SEQ ID NO: 598696 - DNA, 521 bp, Homo sapiens; identical to SEQ ID NO: 539470
  misc_feature: HIJSMM301EUDB3.27.23.C01.1.454.light.4.raw

SEQ ID NO: 598697 - DNA, 476 bp, Homo sapiens
  misc_feature: HIJSMM301A3L0V.9.76.G10.1.454.light.4.raw
tgatacgtctcacgaccggtgctcgatttagtcactcatacagggggggtagagaagacaggactcaggacaatctccagcatggcctggtcccctctcttcctcaccctcatcactcactgtgcagggtcctgggcccagtctgtgctgactcagccaccctcggtgtctggagcccccaggcagagggtcaccatctcctgttctggaagcagctccaacatcggacataatggtgtaaactggtatcagcagctcccgggaaaggctcccaaactcctcatctattatgatgatctgctgccctcaggggtctctgaccgattctctggctccaagtctggcacctcagcctccctggccatcagtgggctccagtctgaggatgaggctgattattactgtggagcatgggatgacagcctgaatgcttggatgttcggcggagggaccaagctgaccgtctaggtcagccc

SEQ ID NO: 598698 - DNA, 483 bp, Homo sapiens; identical to SEQ ID NO: 536526
  misc_feature: HIJSMM301BBQXX.10.3.A03.1.454.light.4.raw

SEQ ID NO: 598699 - DNA, 517 bp, Homo sapiens
  misc_feature: HIJSMM301CGFPN.22.28.C06.1.454.light.4.raw
acatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgacggatgaggctgattattactgtgcagcatgggattacaacctgagtgatcctagttgggtgttcggcggagggaccaggctgaccgtcctaggtcagcccaaggctgtccccccg

SEQ ID NO: 598700 - DNA, 485 bp, Homo sapiens; identical to SEQ ID NO: 536695
  misc_feature: HIJSMM301BP93W.10.1.A01.1.454.light.4.raw

SEQ ID NO: 598701 - DNA, 472 bp, Homo sapiens
  misc_feature: HIJSMM301ATVCU.15.81.H04.1.454.light.4.raw
tctacgtagccacgaccggtgctcgatttagtagtgtagattcgcggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtaactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgccccctcggtcactctgttcccgccctcctcgctacgtaga

SEQ ID NO: 598702 - DNA, 476 bp, Homo sapiens
  misc_feature: HIJSMM301EOZS1.3.1.A01.1.454.light.4.raw
agacgcactccacgaccggtgctcgatttagacgtctcatcaggggggagtcagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggcaacttattactgccaacagtatgatagttattggacgttcggccaagggaccaagatagaaatcaaacgaactagtggctgcaccat

SEQ ID NO: 598703 - DNA, 476 bp, Homo sapiens
  misc_feature: HIJSMM301C22WL.49.37.D04.1.454.light.4.raw
agtcgagagacacgaccggtgctcgatttagtagcatactgttgggtttgggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcggggggaccgaaggtggagatcaagcgaactgtgg

SEQ ID NO: 598704 - DNA, 506 bp, Homo sapiens
  misc_feature: HIJSMM301C06S1.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccacgttcggccctgggaccaaagtggatatcaaacgaactagtggctgcaccatctgtctt

SEQ ID NO: 598705 - DNA, 504 bp, Homo sapiens
  misc_feature: HIJSMM301E3JF1.21.65.F10.1.454.light.4.raw
tcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggctcctcatctatggtgcatccgccagggccactggaatcccagccaggttcagtggcactgggtctgggacagagttcactctcaccatcagcagcctgcagtctgaagattttgaagtttatttctgtctgcagtacaatcagtggcctcggacgtcgtccgacggaccgaacggtacggaaagtactaacgaaacgtacgtaggcgtgcgaccactactcgttcttct

SEQ ID NO: 598706 - DNA, 484 bp, Homo sapiens; identical to SEQ ID NO: 535400
  misc_feature: HIJSMM301CAW52.46.26.C04.1.454.light.4.raw

SEQ ID NO: 598707 - DNA, 521 bp, Homo sapiens; identical to SEQ ID NO: 539470
  misc_feature: HIJSMM301CXVR1.27.23.C01.1.454.light.4.raw

SEQ ID NO: 598708 - DNA, 505 bp, Homo sapiens; identical to SEQ ID NO: 535503
  misc_feature: HIJSMM301AERXG.8.28.C06.1.454.light.4.raw

SEQ ID NO: 598709 - DNA, 497 bp, Homo sapiens
  misc_feature: HIJSMM301ANTYB.43.34.D01.1.454.light.4.raw
tgtgagtagtcacgaccggtgctcgatttagatcgtctgtgttgagtttgggggctttgcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaaccccactgtcactctgttcccgccctcctcactactca

SEQ ID NO: 598710 - DNA, 505 bp, Homo sapiens
  misc_feature: HIJSMM301AYG9J.5.24.C02.1.454.light.4.raw
atcagacacgcacgaccggtgctcgatttagtacagatcgttagggaaagggggggtcgtcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtctaggtcagcccaaggctgcccccg

SEQ ID NO: 598711 - DNA, 489 bp, Homo sapiens
  misc_feature: HIJSMM301C6C1S.14.53.E09.1.454.light.4.raw
cgtctagtaccacgaccggtgctcgatttagagagagtgtgttgggtttgggggggaggcctagctgtgctgtgggtccgaggaggcagaactctgggtggtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggttaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggaggaccaagctgaccgtccta

SEQ ID NO: 598712 - DNA, 505 bp, Homo sapiens; identical to SEQ ID NO: 571264
  misc_feature: HIJSMM301EDBPU.19.78.H01.1.454.light.4.raw

SEQ ID NO: 598713 - DNA, 418 bp, Homo sapiens; identical to SEQ ID NO: 536277
  misc_feature: HIJSMM301A5RKQ.19.86.H09.1.454.light.4.raw

SEQ ID NO: 598714 - DNA, 444 bp, Homo sapiens; identical to SEQ ID NO: 534993
  misc_feature: HIJSMM301CZB4R.5.9.A09.1.454.light.4.raw

SEQ ID NO: 598715 - DNA, 516 bp, Homo sapiens; identical to SEQ ID NO: 547638
  misc_feature: HIJSMM301CA4K4.47.53.E09.1.454.light.4.raw

SEQ ID NO: 598716 - DNA, 494 bp, Homo sapiens; identical to SEQ ID NO: 539784
  misc_feature: HIJSMM301A3SVE.22.57.F02.1.454.light.4.raw

SEQ ID NO: 598717 - DNA, 494 bp, Homo sapiens; identical to SEQ ID NO: 539894
  misc_feature: HIJSMM301BQSLK.16.53.E09.1.454.light.4.raw

SEQ ID NO: 598718 - DNA, 482 bp, Homo sapiens
  misc_feature: HIJSMM301EQHVT.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagattttgcaacttactattgtcaacaggctaacagtttcccgctcaccttcggcggggggaccgaaggtggaggatcaaacgaaactgtggctgcacc

SEQ ID NO: 598719 - DNA, 512 bp, Homo sapiens
  misc_feature: HIJSMM301COC5H.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccgaagggaccaaggtggaagtcaagcgaactgtggctgcaccatctgtcttcatcttcccgccact

SEQ ID NO: 598720 - DNA, 495 bp, Homo sapiens
  misc_feature: HIJSMM301ECIFS.15.28.C06.1.454.light.4.raw
tctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcagcggcagtggatctgggacagaattcagtctcaccatcagcagcctgcagcctgacgattttgcaacttactactgccaacgtgcataataatcatttcggtcggagggaccgaacggtagggagatacaaacgaactagtggctgcaccatctgtctttcactt

SEQ ID NO: 598721 - DNA, 498 bp, Homo sapiens
  misc_feature: HIJSMM301B90P4.9.53.E09.1.454.light.4.raw
tgatacgtctcacgaccggtgctcgatttagagagagtgtgtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctggaggacgaggctgattattactgctgctcatatgcagatggtgacactcccgtggtattcggcggagggaccaaggtgaccgtcctaggtcagcccaaggctgccccctc

SEQ ID NO: 598722 - DNA, 500 bp, Homo sapiens
  misc_feature: HIJSMM301DZGY1.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggacaaggtcaccgtctaggtcagcccaaggccaaccca

SEQ ID NO: 598723 - DNA, 493 bp, Homo sapiens; identical to SEQ ID NO: 537422
  misc_feature: HIJSMM301AY0YE.9.34.D01.1.454.light.4.raw

SEQ ID NO: 598724 - DNA, 502 bp, Homo sapiens
  misc_feature: HIJSMM301ED5KL.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttggaactgggaccaaggtcacgtccaggtcagcccaaggccaacccactgtca

SEQ ID NO: 598725 - DNA, 496 bp, Homo sapiens
  misc_feature: HIJSMM301A4FBI.12.38.D05.1.454.light.4.raw
atacgacgtacacgaccggtgctcgatttagtatctgatagttgggtttgggggaactgctcagttaggacccagacggaaccatggaagccccagcgcagcttctcttcctcctgctactctggctcccagattcctctggagaagttgtgatgacgcagtctccagccaccctgtctgcgtctccaggggaaagagtcaccctctcatgcagggccagtgagattgttaccaccaacttagcctggtaccaacagaaacctggccagcctcccaggctcctcatttatggtgcatccacaagggccgctggtgtcccagccaggttcagtggcagtggatctgcgacagagttcactctcaccgtcagcagcctgcagtctgaagattttgcagtttattactgtcagcagtatgagaagtggttcaagactttcggcggagggaccgaaggtggagatcaaacgaactagtggctgcaccatctgtcttcatt

SEQ ID NO: 598726 - DNA, 505 bp, Homo sapiens
  misc_feature: HIJSMM301CCG5Y.11.67.G01.1.454.light.4.raw
cgagagataccacgaccggtgctcgatttagagtatacatattgggtttgggggggttgagaagacaggactcaggacaatctccagcatggccagcttccctctcctcctcaccctcctcactcactgtgcagggtcctgggcccagtctgttctgactcagccaccctcagcgtctcgggacccccgggcagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctggcacctcagcctccctggcctgcagtgggctccagtctgaggatgaggctgactattattgtgcagcgtgggatgacggtctgagtgctgtggtcttcggcggagggaccaagctgaccgtcctggtcagcccaaggctgccccctcggtcact

SEQ ID NO: 598727 - DNA, 484 bp, Homo sapiens
  misc_feature: HIJSMM301DLXZG.46.26.C04.1.454.light.4.raw
actagcagtacacgaccggtgctcgatttagtctagcgactttgggtttgggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattatgcatgcaagctctacaagtcccgctcactttcggcggagggaccaaggtggagatcaaacgaa

SEQ ID NO: 598728 - DNA, 499 bp, Homo sapiens
  misc_feature: HIJSMM301AD4ZH.51.26.C04.1.454.light.4.raw
cgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggctgcggattttcggcggagggaccagtctgaccgtcctaggtcagccaaggctgccccctcggtcactctcg

SEQ ID NO: 598729 - DNA, 502 bp, Homo sapiens; identical to SEQ ID NO: 559944
  misc_feature: HIJSMM301EZEK2.10.71.G05.1.454.light.4.raw

SEQ ID NO: 598730 - DNA, 505 bp, Homo sapiens
  misc_feature: HIJSMM301ANUCA.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccacttcggccctgggaccaaagtggatatcaaacgaactagtggctgcaccatctgtctt

SEQ ID NO: 598731 - DNA, 487 bp, Homo sapiens; identical to SEQ ID NO: 548740
  misc_feature: HIJSMM301EPZ89.19.71.G05.1.454.light.4.raw

SEQ ID NO: 598732 - DNA, 514 bp, Homo sapiens; identical to SEQ ID NO: 538153
  misc_feature: HIJSMM301B3M1M.17.37.D04.1.454.light.4.raw

SEQ ID NO: 598733 - DNA, 475 bp, Homo sapiens; identical to SEQ ID NO: 537714
  misc_feature: HIJSMM301CDLVA.7.81.H04.1.454.light.4.raw

SEQ ID NO: 598734 - DNA, 502 bp, Homo sapiens; identical to SEQ ID NO: 541971
  misc_feature: HIJSMM301D31F9.4.39.D06.1.454.light.4.raw

SEQ ID NO: 598735 - DNA, 519 bp, Homo sapiens
  misc_feature: HIJSMM301D3S7H.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactcgtcactctgttcccaccctctccgtgt

SEQ ID NO: 598736 - DNA, 519 bp, Homo sapiens; identical to SEQ ID NO: 543692
  misc_feature: HIJSMM301B0X95.41.19.B08.1.454.light.4.raw

SEQ ID NO: 598737 - DNA, 505 bp, Homo sapiens; identical to SEQ ID NO: 535503
  misc_feature: HIJSMM301CL72F.8.28.C06.1.454.light.4.raw

SEQ ID NO: 598738 - DNA, 508 bp, Homo sapiens; identical to SEQ ID NO: 595080
  misc_feature: HIJSMM301BUT4J.17.28.C06.1.454.light.4.raw

SEQ ID NO: 598739 - DNA, 508 bp, Homo sapiens
  misc_feature: HIJSMM301ESX1I.19.78.H01.1.454.light.4.raw
tactctcgtgcacgaccggtgctcgatttagtgtgagtagtttgggtttggggggggtcgacaagaggcagcgctctcgggacggtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtca

SEQ ID NO: 598740 - DNA, 526 bp, Homo sapiens
  misc_feature: HIJSMM301AVTZS.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccgaacgggaccgaacggtaggaagtacgaaacggaaacctagtaggcgtgcaccactctgtcttctactcttcccgtccctact

SEQ ID NO: 598741 - DNA, 485 bp, Homo sapiens
  misc_feature: HIJSMM301D684W.52.68.G02.1.454.light.4.raw
cgcagtacgacacgaccggtgctcgatttagtcgatagtgaagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggcaccaacagtgattttggtggttatgattctgtcttctggtaccaacggcacccaggcaaagtccccaaactcatgattactgatatcaataagaggccctcaggggtccctgatcgcttctctggctccaagtctggcaacacggcctccctgaccatctctgggctccaggctgaggatgaggctgaatatttctgctgctcatatgcaggcggctacacttatgtcttcggaactgggacccaggtcaccgtcctaggtca

SEQ ID NO: 598742 - DNA, 486 bp, Homo sapiens; identical to SEQ ID NO: 535385
  misc_feature: HIJSMM301EPHWQ.19.71.G05.1.454.light.4.raw

SEQ ID NO: 598743 - DNA, 489 bp, Homo sapiens; identical to SEQ ID NO: 535139
  misc_feature: HIJSMM301AFEZL.14.55.E11.1.454.light.4.raw

SEQ ID NO: 598744 - DNA, 502 bp, Homo sapiens; identical to SEQ ID NO: 580440
  misc_feature: HIJSMM301BU5OR.2.35.D02.1.454.light.4.raw

SEQ ID NO: 598745 - DNA, 495 bp, Homo sapiens; identical to SEQ ID NO: 535596
  misc_feature: HIJSMM301AIZLU.10.79.H02.1.454.light.4.raw

SEQ ID NO: 598746 - DNA, 469 bp, Homo sapiens
  misc_feature: HIJSMM301B6Q8S.3.56.F01.1.454.light.4.raw
agacgcactccacgaccggtgctcgatttagcagacgtctgaacacacaaagggggcaggagtcagtcccaaccaggacacagcatggacatgagggtccctgcccagctcctggggctcctgctgctctggctctcaggtgccagatgtgacatccagatgacccagtctccaccctccctgtctgcttctgtaggagatagagtcatcatcacttgccaggcgagtcaagacattagtgacaatttaaattggtatcaccagaaaccagggaagccctaagctcctgatctacgatgcatccagtttgcaaacaggggtcccatcaaggttcagtggacgtggatctgggacagatttcacttgcaccatcagcggcctgcagcctgaagatgttggaacatattactgtcaacagtatgatcagctcctttctttcggccctgggaccaaagtgaaatcaggcgaa

SEQ ID NO: 598747 - DNA, 501 bp, Homo sapiens; identical to SEQ ID NO: 548645
  misc_feature: HIJSMM301AESPP.14.23.C01.1.454.light.4.raw

SEQ ID NO: 598748 - DNA, 511 bp, Homo sapiens; identical to SEQ ID NO: 550512
  misc_feature: HIJSMM301DRM1J.17.2.A02.1.454.light.4.raw

SEQ ID NO: 598749 - DNA, 511 bp, Homo sapiens; identical to SEQ ID NO: 583742
  misc_feature: HIJSMM301D2CGO.41.30.C08.1.454.light.4.raw

SEQ ID NO: 598750 - DNA, 493 bp, Homo sapiens
  misc_feature: HIJSMM301DQ4DJ.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatatttcgtgctccgtacacttttggccaggggacccaggtggagatcagacgaactgtggctgcaccatctgtcttcatctcccg

SEQ ID NO: 598751 - DNA, 442 bp, Homo sapiens
  misc_feature: HIJSMM301ECCSL.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagttcctttgacattaaactggatgtggtattcggcggagggacccacgtaaccgtcctaggtcagcccaaggctgccccctcggtcactctgttcccaccctcctcgtatctctcg

SEQ ID NO: 598752 - DNA, 517 bp, Homo sapiens; identical to SEQ ID NO: 587836
  misc_feature: HIJSMM301DCGX5.14.70.G04.1.454.light.4.raw
  modified_base (507)..(507): a, c, t, g, unknown or other

SEQ ID NO: 598753 - DNA, 486 bp, Homo sapiens; identical to SEQ ID NO: 535043
  misc_feature: HIJSMM301AV7J9.46.35.D02.1.454.light.4.raw

SEQ ID NO: 598754 - DNA, 502 bp, Homo sapiens; identical to SEQ ID NO: 543172
  misc_feature: HIJSMM301D9D9P.18.59.F04.1.454.light.4.raw

SEQ ID NO: 598755 - DNA, 494 bp, Homo sapiens; identical to SEQ ID NO: 534994
  misc_feature: HIJSMM301ED008.27.78.H01.1.454.light.4.raw

SEQ ID NO: 598756 - DNA, 507 bp, Homo sapiens; identical to SEQ ID NO: 564521
  misc_feature: HIJSMM301A4VO7.21.87.H10.1.454.light.4.raw

SEQ ID NO: 598757 - DNA, 484 bp, Homo sapiens; identical to SEQ ID NO: 535400
  misc_feature: HIJSMM301AW8X4.46.26.C04.1.454.light.4.raw

SEQ ID NO: 598758 - DNA, 511 bp, Homo sapiens; identical to SEQ ID NO: 541549
  misc_feature: HIJSMM301CP1WB.40.33.C11.1.454.light.4.raw

SEQ ID NO: 598759 - DNA, 491 bp, Homo sapiens
  misc_feature: HIJSMM301CW8I9.49.20.B09.1.454.light.4.raw
agtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacaatatgcttactggtaccagcagaggccaggccaggcccctgtcttggtgatttataaagactttgagaggccctcagggacccctgagcgattctctggctccagctcagggacaacagtcaccttgaccatcagtggagtccggccagaggacgaggctgactattactgtcagtccgcagacagcagtggcagttatgtcgtattcggcggagggactacgctgaccgtctaggtcagcccaaggctcgccccctcggt

SEQ ID NO: 598760 - DNA, 481 bp, Homo sapiens; identical to SEQ ID NO: 582425
  misc_feature: HIJSMM301BKMJI.14.11.A11.1.454.light.4.raw

SEQ ID NO: 598761 - DNA, 482 bp, Homo sapiens
  misc_feature: HIJSMM301EHBMJ.10.4.A04.1.454.light.4.raw
catagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagccaccattacatgctctggagaagcgttgagcgataaatttgtttcgtggtataaacagaagtcaggccagtcgcctgtgttggtcatctatcaaaatattaagcggccctcaggggtccctgagcgaatctctggcgccaagtctgggaccacaggcacgctgaccatcagtgtgacccaggctgtggatgaggcagactattactgtcaggcgtgggacagtagcgctgtgattttcggcggagggaccaagctgaccgtcctaggtcagcccaaggctcgcccctcc

SEQ ID NO: 598762 - DNA, 495 bp, Homo sapiens; identical to SEQ ID NO: 546081
  misc_feature: HIJSMM301AH0WZ.13.46.E02.1.454.light.4.raw

SEQ ID NO: 598763 - DNA, 481 bp, Homo sapiens; identical to SEQ ID NO: 537819
  misc_feature: HIJSMM301BL9I9.22.59.F04.1.454.light.4.raw

SEQ ID NO: 598764 - DNA, 507 bp, Homo sapiens; identical to SEQ ID NO: 549050
  misc_feature: HIJSMM301A3ZL3.18.37.D04.1.454.light.4.raw

SEQ ID NO: 598765 - DNA, 517 bp, Homo sapiens; identical to SEQ ID NO: 536980
  misc_feature: HIJSMM301C4K1L.5.27.C05.1.454.light.4.raw

SEQ ID NO: 598766 - DNA, 502 bp, Homo sapiens
  misc_feature: HIJSMM301DWY2R.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatacaaaacgaactgtggctgcaccatctgtcttcattcttcccgccatctgacta

SEQ ID NO: 598767 - DNA, 502 bp, Homo sapiens; identical to SEQ ID NO: 541971
  misc_feature: HIJSMM301DMOOG.4.39.D06.1.454.light.4.raw

SEQ ID NO: 598768 - DNA, 477 bp, Homo sapiens
  misc_feature: HIJSMM301CUNNE.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctcctggtcatcgctgggctccaggctgacgatgaggctgattattattgccagtcctatgacaacaccctgcgtggttttggctgttcgcggcggac

SEQ ID NO: 598769 - DNA, 500 bp, Homo sapiens; identical to SEQ ID NO: 592300
  misc_feature: HIJSMM301EANK9.14.57.F02.1.454.light.4.raw

SEQ ID NO: 598770 - DNA, 492 bp, Homo sapiens; identical to SEQ ID NO: 573597
  misc_feature: HIJSMM301CCW0M.10.72.G06.1.454.light.4.raw

SEQ ID NO: 598771 - DNA, 501 bp, Homo sapiens
  misc_feature: HIJSMM301EW88T.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaagggaccgaaggtggaaagtcaaacgaaactgtggctgcacc

SEQ ID NO: 598772 - DNA, 485 bp, Homo sapiens; identical to SEQ ID NO: 535688
  misc_feature: HIJSMM301D1FB6.19.5.A05.1.454.light.4.raw

SEQ ID NO: 598773 - DNA, 462 bp, Homo sapiens; identical to SEQ ID NO: 542244
  misc_feature: HIJSMM301B6N5D.49.73.G07.1.454.light.4.raw

SEQ ID NO: 598774 - DNA, 503 bp, Homo sapiens
  misc_feature: HIJSMM301BWVL2.48.36.D03.1.454.light.4.raw
agtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttcaagttcctttttgtcttcggaactggaccgaggtcaccgtcctaggtcagcccaaggccaaccccactgtcta

SEQ ID NO: 598775 - DNA, 460 bp, Homo sapiens; identical to SEQ ID NO: 536053
  misc_feature: HIJSMM301AYXU8.22.28.C06.1.454.light.4.raw

SEQ ID NO: 598776 - DNA, 480 bp, Homo sapiens
  misc_feature: HIJSMM301DUVQD.51.72.G06.1.454.light.4.raw
cgatcgtatacacgaccggtgctcgatttagctacgactgcaagggaaaggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcatttctttagcctggtatcagcaaaaaccagggaaagcccctaagctcctgatctatgctgcatccactttgcaaactggagtcccatcaaggttcagcggcagtggatctgggacagaattcactctcacaatcagcagcctgcagcctgaagattttgcaacttattactgtcaacagcttaatacttatcctcggacttcggccaaggaccaaggtaggaaatacaaacgaactagtggctgcaccat

SEQ ID NO: 598777 - DNA, 509 bp, Homo sapiens
  misc_feature: HIJSMM301A6OLD.12.48.E04.1.454.light.4.raw
atacgacgtacacgaccggtgctcgatttagagagcgtcacagagagaaggggagagaagacaggactcaggacaatctccagcatggccagcttccctctcctcctcaccctcctcactcactgtgcagggtcctgggcccagtctgtgctgactcagccaccctcagcgtctcgggacccccgggcagagggtcaccatttcttgttctggaacccactccaacatcggatataattctgtagactggtaccagcagcttccaggagccggccccccgactcctcatctttaataacaatcagcggccctcaggggtccctgaccgattctctggctccaagtctggcacctcagcctccctggccatcagtgggctccagtctgaggatgaggctgattattactgtgcatcatgggctgacaccctgactggtccgggagtgttcggcggagggaccaagctgaccgtcctaggtcagcccaaggcagccccctcggtcactccg

SEQ ID NO: 598778 - DNA, 497 bp, Homo sapiens; identical to SEQ ID NO: 536376
  misc_feature: HIJSMM301A15EA.22.9.A09.1.454.light.4.raw

SEQ ID NO: 598779 - DNA, 505 bp, Homo sapiens
  misc_feature: HIJSMM301DXO5K.43.4.A04.1.454.light.4.raw
tgtgagtagtcacgaccggtgctcgatttagagtagtgatcagggtcattaatgtcagcggcacagcaaccgcgggcactttcggcggagggaccaaggtggagatcaagcgtgagtgcactttcctagtgctttttcttataaggcctgaaatttggagtctttttgtgtttgagacattacctcaggtccattccagagagttccagaggtccattccagagagttccagaggctttcaaaaaggtccgatgagtaagggatcgaaagttagtccatcttaaggagcagccaagcgctggtcagttaagagcggcgcctcatttgcaagattttctctgcgtcggccaggttagtgatcttcacgacgaaaagacatttttcttgagggaaaagtattaagttaatgttgtggatcagcttcggccaagggacgcgactggagattaaacgaactgtggctgcaccatctgtcttcatcttcccgccatctgaactactcaca

SEQ ID NO: 598780 - DNA, 511 bp, Homo sapiens
  misc_feature: HIJSMM301AXALR.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtccgtgggtcagcccaaggcctgccccctcggtcctaccg

SEQ ID NO: 598781 - DNA, 488 bp, Homo sapiens; identical to SEQ ID NO: 542699
  misc_feature: HIJSMM301COOPX.12.51.E07.1.454.light.4.raw

SEQ ID NO: 598782 - DNA, 492 bp, Homo sapiens
  misc_feature: HIJSMM301CHHP9.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcagggtggaggctgaggatgttggggtttgttcctccatgcaaggtacacactggccttttggccaggggccaacctggagatcaaatgaactgtggctgcaccatctgtctt

SEQ ID NO: 598783 - DNA, 504 bp, Homo sapiens
  misc_feature: HIJSMM301BOSJE.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactattaaattggtatcaacaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggagatcaaacgaaactgtggctgcaccatctgtcttcatcttcccgccat

SEQ ID NO: 598784 - DNA, 503 bp, Homo sapiens; identical to SEQ ID NO: 538884
  misc_feature: HIJSMM301DWC9H.27.78.H01.1.454.light.4.raw

SEQ ID NO: 598785 - DNA, 514 bp, Homo sapiens; identical to SEQ ID NO: 543870
  misc_feature: HIJSMM301ELHOP.40.12.B01.1.454.light.4.raw

SEQ ID NO: 598786 - DNA, 494 bp, Homo sapiens
  misc_feature: HIJSMM301AHHQS.16.86.H09.1.454.light.4.raw
tgtactactccacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtcctaggtcagcccaaggctg

SEQ ID NO: 598787 - DNA, 501 bp, Homo sapiens
  misc_feature: HIJSMM301CAGN0.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtccgggacagagttcactctcaccatcagcagcctgcagtctgaagattttgcggtttattactgtcagcagtataataactggcctccacggtactacttttggccaggggaccaagctggagatacaaacgaactgtggctgcaccatctgtctt

SEQ ID NO: 598788 - DNA, 517 bp, Homo sapiens
  misc_feature: HIJSMM301DGYVL.49.17.B06.1.454.light.4.raw
agtcgagagacacgaccggtgctcgatttagtcgatagtgaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtgtttataactatgtctcctggtaccaacaccacccaggcaaagcccccaaactcatgatttatgatgtcagtgatcggccctcaggggtttcgaatcgcttctctggctccaagtccggcaacacggcctccctgacccatctctggcctccaggccgaggacgaggctgattattactgcagctcatatacaaccagcaacaattgggtgttcggcggagggaccaaactgaccgtcctaggtcagcccaaggctgccccctcggtcactctgttcccacctcct

SEQ ID NO: 598789 - DNA, 503 bp, Homo sapiens; identical to SEQ ID NO: 537189
  misc_feature: HIJSMM301DJ56B.19.85.H08.1.454.light.4.raw

SEQ ID NO: 598790 - DNA, 485 bp, Homo sapiens
  misc_feature: HIJSMM301BV9DO.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcatgcacagattttacactgaaaatcagcagagtggaggctgaggatgttgggctctattattgcatgcaagctctacaagtcccgctcactttcggcggagggaccaaggtgagatcaaacgaacg

SEQ ID NO: 598791 - DNA, 502 bp, Homo sapiens
  misc_feature: HIJSMM301AJ6FM.41.14.B03.1.454.light.4.raw
tctatactatcacgaccggtgctcgatttagtgtgagtagttccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagcccaaggctgccccctc

SEQ ID NO: 598792 - DNA, 495 bp, Homo sapiens; identical to SEQ ID NO: 568500
  misc_feature: HIJSMM301BH1D1.5.12.B01.1.454.light.4.raw

SEQ ID NO: 598793 - DNA, 486 bp, Homo sapiens
  misc_feature: HIJSMM301A3NVM.21.25.C03.1.454.light.4.raw
  modified_base (451)..(451): a, c, t, g, unknown or other
  modified_base (454)..(454): a, c, t, g, unknown or other
  modified_base (456)..(456): a, c, t, g, unknown or other
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaaactcctcatctatggtaaacagcaatcggccctcaggggtccctgaccgattctctggctccaaagtctggcaacctcagcctccctggtcatgctgggctccaaggctgacgatgaggctgattatattgcatccatgacaacaaccnccngnggtttgtcgtgttcgcggcggacgacgacg

SEQ ID NO: 598794 - DNA, 487 bp, Homo sapiens; identical to SEQ ID NO: 539157
  misc_feature: HIJSMM301DRG08.26.37.D04.1.454.light.4.raw

SEQ ID NO: 598795 - DNA, 519 bp, Homo sapiens; identical to SEQ ID NO: 544656
  misc_feature: HIJSMM301BMT2M.27.23.C01.1.454.light.4.raw

SEQ ID NO: 598796 - DNA, 488 bp, Homo sapiens
  misc_feature: HIJSMM301AYMWV.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtgggggctgaggatgttggcatttattactgcatgcaggctatcaccttcctgccacttttggccaggggaccaagctggagatcaggcgtaacg

SEQ ID NO: 598797 - DNA, 481 bp, Homo sapiens
  misc_feature: HIJSMM301D2C50.41.36.D03.1.454.light.4.raw
tctatactatcacgaccggtgctcgatttagctgcgtcacgatctctcttggggtctccaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacaatcacctgcactgggaacaacaataatgtcgccaaccaaggagcagcttggctgcagcagcaccagggccaccctcccaaagtcgtatccgacagggataacaatcggcccttagggatctcagagagaatatctgcatccaggtcaggaaacacagcctccctgacccattactggactccaacctgaggacgaggctgactattattgctcagcatgggacaccagcctcaatgccgcggtattcggcgcagggaccaaggctgacccg

SEQ ID NO: 598798 - DNA, 511 bp, Homo sapiens
  misc_feature: HIJSMM301EMTTT.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccgaagggaccgaaggtaggaaagtacaaacgaactagtggctgcaccactctgtcttctactcttccccg

SEQ ID NO: 598799 - DNA, 480 bp, Homo sapiens; identical to SEQ ID NO: 559070
  misc_feature: HIJSMM301DSK8O.21.25.C03.1.454.light.4.raw

SEQ ID NO: 598800 - DNA, 517 bp, Homo sapiens
  misc_feature: HIJSMM301CJE7W.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcaggtgggtatgggacagacttcactctcaccatcatcagcctggagcctgaagatgttgcagtttattactgtcaacatcgtaccgagtggcccgtccgggggccacgtttccggcccgtcgggaccgaaggtggagatacaaacgaactgtggctgcaccatctgtcttcta

SEQ ID NO: 598801 - DNA, 503 bp, Homo sapiens
  misc_feature: HIJSMM301CXJ2D.12.48.E04.1.454.light.4.raw
atacgacgtacacgaccggtgctcgatttagagagcgtcacagagagaaggggagcttcagctgtgggtagagaagacaggactcaggacaatctccagcatggccagcttccctctcctcctcaccctcctcactcactgtgcagggtcctgggcccagtctgtgctgactcagccaccctcagcgtctcgggacccccgggcagagggtcaccatttcttgttctggaacccactccaacatcggatataattctgtagactggtaccagcagcttccaggagccggccccccgactcctcatctttaataacaatcagcggccctcaggggtccctgaccgattctctggctccaagtctggcacctcagcctccctggccatcagtgggctccagtctgaggatgaggctgattattactgtgcatcatgggctgacaccctgactggtccgggagtgttcggcggagggaccaagctgaccgtcctaggtcagcccaa

SEQ ID NO: 598802 - DNA, 489 bp, Homo sapiens; identical to SEQ ID NO: 542614
  misc_feature: HIJSMM301A6LVR.48.75.G09.1.454.light.4.raw

SEQ ID NO: 598803 - DNA, 487 bp, Homo sapiens; identical to SEQ ID NO: 544897
  misc_feature: HIJSMM301AFYSX.46.35.D02.1.454.light.4.raw

SEQ ID NO: 598804 - DNA, 509 bp, Homo sapiens
  misc_feature: HIJSMM301EEP36.40.47.E03.1.454.light.4.raw
tctagcgactcacgaccggtgctcgatttagactcgcgcacagagagaaggggggggtcgtcaggaggcagcactctcgggacggtctccaccatggcctgggctctgctcctcctcagcctcctcactcagggcacaggatcctggactcagtctgccctgactcagcctcgctcagtgtccgggtctcctggacagtcagtcaccctctcctgcactggaaccagcagtaatgttggtggttataactttgtctcctggtaccaacaccacccaggcaaagcccccaaattcttgatttatgatgtcaataagcggccctcaggggtccctgatcgcttctctggctccaagtctggcaacacggcctccctgaccatctctgggctcccaggctgagggatgaggctgattattactgctgctcatttgcaggtagtttttggtggttcggcggagggaccaagctgaccgtcctaggtcacgcccaaggctgccccctcggtcta

SEQ ID NO: 598805 - DNA, 478 bp, Homo sapiens; identical to SEQ ID NO: 569440
  misc_feature: HIJSMM301AL55U.48.5.A05.1.454.light.4.raw

SEQ ID NO: 598806 - DNA, 508 bp, Homo sapiens
  misc_feature: HIJSMM301D9U95.53.20.B09.1.454.light.4.raw
cgcgtatacacacgaccggtgctcgatttagtgtagtgtgaagggggggcctaaggaagcagcactggtggtgcctcagccatggcctggaccgttctcctcctcggcctcctctctcactgcacaggctctgtgacctcctatgtgctgactcagccaccctcggtgtcagtggccccaggaaggacggccacgattacctgtgggggaaacaacattggaagtaaaagtgtgcactggtaccagcacaagccaggccaggcccctgcgctggtcgtctatgatgatagcgaccggccctcagggatccctgagcgattctctggctccaactctggggacacggccaccctgaccatcagcagggtcgaagccggggacgaggccgactattactgtcaggtgtgggattttaatagtgatcattgggtgttcggcggagggaccaagctgaccgtcctaggtcagcccaaggctgccccctcggtcactctgttcccgccctcct

SEQ ID NO: 598807 - DNA, 512 bp, Homo sapiens
  misc_feature: HIJSMM301A95IV.49.23.C01.1.454.light.4.raw
agtcgagagacacgaccggtgctcgatttagtacacgtgattagggattgggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaagatatgcttattggtaccatcagaagtcaggccaggcccctgtactggtcatctatgaggacaccaaacgaccctccgggatccctacgagattctctggctccagtttagggacagtggccaccctgacagtcagtggggcccaggtggaggatgagggtgattactactgttactcaacagacattactactactcatagggtgttcggcggagggaccaagctgaccgtcctaggtcagcccaaggctgccccctcggtcactctcgttcccaccctt

SEQ ID NO: 598808 - DNA, 509 bp, Homo sapiens
  misc_feature: HIJSMM301EIBLU.19.72.G06.1.454.light.4.raw
tactctcgtgcacgaccggtgctcgatttagctacgactgcaagggaaaggggggggtcgcaagaggcagcgctctcgggacgtctccaccatggcctgggctctgctgctcctcactctcctcactcaggacacagggtcctgggcccagtctgccctgactcagcctgcctccgtgtctgagtctcttggacagtcgatcaccatctcctccactgggaccggtcgtgatgttgggacttatacccttgtctcctggtaccaacaataccccggcaaagcccccaaactcctgatttatgaggctcataagcggccctcaggggtttctgagcgcttctctggctccagggctgacaacacggcctacctgacgatctctgggctccaggctgaggacgaggctgactattattgctgcgcatacgcaggaagtagcacatgggtgtgcggcggagggaccaaggtgaccgtcctgggtcagcccaaggctgccccctcggtcactc

SEQ ID NO: 598809 - DNA, 489 bp, Homo sapiens
  misc_feature: HIJSMM301AQ7EW.4.4.A04.1.454.light.4.raw
agcactgtagcacgaccggtgctcgatttagagtagtgatcaggggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgtcgggcaagtcagagtattaatagttggttggcctggtatcaccagagaccaggagaggccccaaggctccttatttatgatgcctccactgtgattagtggggtcccaccaacgttcagcggcagtggatctgggacatacttcactctcaccatcagcagcctgcagcctgatgatcttggaacttattactgccaacagtataatagtttttggacgttcggtccaggggaccgaaggtcgaaatagagacgaactagtggctgcaccatctgtcttcta

SEQ ID NO: 598810 - DNA, 490 bp, Homo sapiens; identical to SEQ ID NO: 554431
  misc_feature: HIJSMM301BYAOT.21.65.F10.1.454.light.4.raw

SEQ ID NO: 598811 - DNA, 487 bp, Homo sapiens; identical to SEQ ID NO: 539157
  misc_feature: HIJSMM301D6D1D.26.37.D04.1.454.light.4.raw

SEQ ID NO: 598812 - DNA, 479 bp, Homo sapiens; identical to SEQ ID NO: 540569
  misc_feature: HIJSMM301ALJFG.5.70.G04.1.454.light.4.raw

SEQ ID NO: 598813 - DNA, 472 bp, Homo sapiens; identical to SEQ ID NO: 558585
  misc_feature: HIJSMM301ADJC8.18.76.G10.1.454.light.4.raw

SEQ ID NO: 598814 - DNA, 499 bp, Homo sapiens; identical to SEQ ID NO: 557364
  misc_feature: HIJSMM301DCK7D.40.57.F02.1.454.light.4.raw

SEQ ID NO: 598815 - DNA, 508 bp, Homo sapiens; identical to SEQ ID NO: 537871
  misc_feature: HIJSMM301AXSJG.8.33.C11.1.454.light.4.raw

SEQ ID NO: 598816 - DNA, 485 bp, Homo sapiens
  misc_feature: HIJSMM301COQIT.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgagattttgcagtctattactgtcagcagtatggtcacgtcccaagaacttttggccaggggaccagctggagatacaaacgaactgtggctgcaccat

SEQ ID NO: 598817 - DNA, 495 bp, Homo sapiens; identical to SEQ ID NO: 535596
  misc_feature: HIJSMM301AS2PJ.10.79.H02.1.454.light.4.raw

SEQ ID NO: 598818 - DNA, 505 bp, Homo sapiens; identical to SEQ ID NO: 535503
  misc_feature: HIJSMM301EU1BP.8.28.C06.1.454.light.4.raw

SEQ ID NO: 598819 - DNA, 495 bp, Homo sapiens
  misc_feature: HIJSMM301ETJ4R.41.38.D05.1.454.light.4.raw
tctatactatcacgaccggtgctcgatttagtatctgatagttgggtttgggggagccagacccagtcaggacacagcatggacatgagggtccccgctcagctcctggggctcctgctgctctggttcccaggttccagatgcgacatccagatgacccagtctccatcttctgtgtctgcatctgtcggagacagagtcaccatcacttgtcgggcgagtcagggtattggcagctacttagtctggtatcaacaaaaaccagggaaagcccctaaactccttatttatggatcatccagtttacaaagtggggtcccatcaaggttcagcggcagtggatctgggacacatttcactctcactatcagcagcctgcagcctgaggatttttgcgacttactattgtcaacaggctgacagtttccctctcactttcggcgagggaccaaggttgagaccaaacgaactgtggctgcaccatctgtcttcatt

SEQ ID NO: 598820 - DNA, 509 bp, Homo sapiens
  misc_feature: HIJSMM301AGZSO.13.73.G07.1.454.light.4.raw
tcacgtactacacgaccggtgctcgatttagctctacgctcaggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaactcattatttacggggtcaataagcggccctcagggctttctgatcgcttctctggctccaagtctggcaacacggcctccctgacaatctctggactccaggccgaggacgaggctgatttttactgttgttcatatgcaggaaggagtgattatgtctttggaagtgggaccaaggtcaccgtccttggtcagccaaggccaaccccactgtcacctctgttccc

SEQ ID NO: 598821 - DNA, 512 bp, Homo sapiens
  misc_feature: HIJSMM301DDFUM.5.58.F03.1.454.light.4.raw
atcagacacgcacgaccggtgctcgatttagtctgatcgagaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtcagcccaaggccaacccactgtcactcttcg

SEQ ID NO: 598822 - DNA, 495 bp, Homo sapiens
  misc_feature: HIJSMM301BLAXJ.22.86.H09.1.454.light.4.raw
acatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggctgccccctggtccactctgttcccgcctcct

SEQ ID NO: 598823 - DNA, 521 bp, Homo sapiens
  misc_feature: HIJSMM301ESY02.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgctttataactttatctgttggtaccgacaggacccaggcactgtccccaaactcattctttatgatgtcagtaatcggcccccaggggtttctgatcgcttctatggctccaagtctgcctacacggcctcctgaccatctccgggctccagcctgaggacgaggctgattattattgtagttcatatacaaccagtgacacttgggtgttcggcggagggaccaggctgaccgtcctaggtcagcccaaggcctgccccctggtcactctgttcccgccct

SEQ ID NO: 598824 - DNA, 519 bp, Homo sapiens
  misc_feature: HIJSMM301EQMGZ.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcgtccgaacgggaccgaacggtaggaagtacgaaacgaactagtaggcgtgcgaccatctgtcttctatcttcccgtcccact

SEQ ID NO: 598825 - DNA, 494 bp, Homo sapiens; identical to SEQ ID NO: 536221
  misc_feature: HIJSMM301AL17C.15.59.F04.1.454.light.4.raw

SEQ ID NO: 598826 - DNA, 508 bp, Homo sapiens
  misc_feature: HIJSMM301DP7AH.8.42.D09.1.454.light.4.raw
ctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgattttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctcggtcactctgttcccacctcc

SEQ ID NO: 598827 - DNA, 505 bp, Homo sapiens
  misc_feature: HIJSMM301BAYD9.10.29.C07.1.454.light.4.raw
catagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttttgatgtcagtaatcggccctcaggggtttctaatcgcttctctggctccaagtctggcaacacggcctccctgaccatctctgggctccaggctgaggacgaggctgattattactgcagctcatatacaaccagcagcacttctgtattcggcggagggaccaagctgaccgtcctaggtcagcccaaggctgccccctggtcta

SEQ ID NO: 598828 - DNA, 497 bp, Homo sapiens
  misc_feature: HIJSMM301DIIY6.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtgaggctgaggatgttgcggtttattactgcctgcagagtattcactggccgtggacgttcggccaagggaccaaggtggaatacaaacgaactgtggctgcacc

SEQ ID NO: 598829 - DNA, 489 bp, Homo sapiens; identical to SEQ ID NO: 535139
  misc_feature: HIJSMM301AUGFW.14.55.E11.1.454.light.4.raw

SEQ ID NO: 598830 - DNA, 444 bp, Homo sapiens; identical to SEQ ID NO: 537971
  misc_feature: HIJSMM301D58YB.2.76.G10.1.454.light.4.raw

SEQ ID NO: 598831 - DNA, 521 bp, Homo sapiens; identical to SEQ ID NO: 539470
  misc_feature: HIJSMM301A4K06.27.23.C01.1.454.light.4.raw

SEQ ID NO: 598832 - DNA, 441 bp, Homo sapiens; identical to SEQ ID NO: 551059
  misc_feature: HIJSMM301CGPNK.11.3.A03.1.454.light.4.raw
  modified_base (423)..(423): a, c, t, g, unknown or other

SEQ ID NO: 598833 - DNA, 486 bp, Homo sapiens
  misc_feature: HIJSMM301BJE38.17.25.C03.1.454.light.4.raw
cgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacagttccctcgcacttttggccaggggaccaaagttgagatcaaacgaactgtggctgcaccatctgtt

SEQ ID NO: 598834 - DNA, 487 bp, Homo sapiens; identical to SEQ ID NO: 593443
  misc_feature: HIJSMM301CKZZ9.13.87.H10.1.454.light.4.raw

SEQ ID NO: 598835 - DNA, 513 bp, Homo sapiens; identical to SEQ ID NO: 543780
  misc_feature: HIJSMM301BUSAV.17.33.C11.1.454.light.4.raw

SEQ ID NO: 598836 - DNA, 484 bp, Homo sapiens
  misc_feature: HIJSMM301B9RBU.49.81.H04.1.454.light.4.raw
agtcgagagacacgaccggtgctcgatttagtagtgtagattcgcggggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggcggagggaccacggtggagatcaaacgaactgtggctgcaccatctgtt

SEQ ID NO: 598837 - DNA, 504 bp, Homo sapiens
  misc_feature: HIJSMM301DNGM7.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggcctcgggaccaaagtggatatcaaacgaactgtggctgcaccatctgtt

SEQ ID NO: 598838 - DNA, 507 bp, Homo sapiens
  misc_feature: HIJSMM301AL7G6.13.55.E11.1.454.light.4.raw
tcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcaccatcacttgccgggcaagtcagagcattaccaactatttgaattggtatcaacaaaaaccagggagagcccctcacctccttatctatggtgcatccaccttacaaagtggggtcccatcaaggttcagtggcactggatctgggacagatttcactctcaccatcagcagtctgcaacctgaagattttgcaacttattactgtcaacagagtttcagtacgcggacgttcggtccaagggaccgaacggtggaaagtacaaacgaactagtggctgcaccatctgtcttctactcttccccg

SEQ ID NO: 598839 - DNA, 501 bp, Homo sapiens; identical to SEQ ID NO: 536142
  misc_feature: HIJSMM301D1U09.15.1.A01.1.454.light.4.raw

SEQ ID NO: 598840 - DNA, 500 bp, Homo sapiens
  misc_feature: HIJSMM301BRIFJ.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcatgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaacccac

SEQ ID NO: 598841 - DNA, 502 bp, Homo sapiens
  misc_feature: HIJSMM301DIXWC.48.41.D08.1.454.light.4.raw
agtatacatacacgaccggtgctcgatttagtcacgcgagaaagggaaaggggagagaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcta

SEQ ID NO: 598842 - DNA, 500 bp, Homo sapiens; identical to SEQ ID NO: 560122
  misc_feature: HIJSMM301BDA0E.9.81.H04.1.454.light.4.raw

SEQ ID NO: 598843 - DNA, 496 bp, Homo sapiens
  misc_feature: HIJSMM301B0172.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacaggagttcactctcaccatcagcagcctgcagtctgaagattttgctagtttattactgtcagcagtataataactggttcctgctcactttcggcgggggaccgaaggtggagatcaaacgaactgtggctgcaccatctgtt

SEQ ID NO: 598844 - DNA, 453 bp, Homo sapiens; identical to SEQ ID NO: 544521
  misc_feature: HIJSMM301EG8KP.19.86.H09.1.454.light.4.raw

SEQ ID NO: 598845 - DNA, 493 bp, Homo sapiens; identical to SEQ ID NO: 536534
  misc_feature: HIJSMM301ANZTG.43.72.G06.1.454.light.4.raw

SEQ ID NO: 598846 - DNA, 487 bp, Homo sapiens; identical to SEQ ID NO: 536536
  misc_feature: HIJSMM301AR346.26.45.E01.1.454.light.4.raw

SEQ ID NO: 598847 - DNA, 507 bp, Homo sapiens; identical to SEQ ID NO: 535930
  misc_feature: HIJSMM301BYEYA.15.34.D01.1.454.light.4.raw

SEQ ID NO: 598848 - DNA, 520 bp, Homo sapiens
  misc_feature: HIJSMM301DJY10.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccgggatgaggccgactattactgtcaggtgtggaatggtgattatgattatgtcttcggaactgggaccaaggtcaccgtcctaggtcagcccaaggccaaccccactgtcactctcgttcccgccctcctccgtcgt

SEQ ID NO: 598849 - DNA, 489 bp, Homo sapiens; identical to SEQ ID NO: 538618
  misc_feature: HIJSMM301C13GW.12.88.H11.1.454.light.4.raw

SEQ ID NO: 598850 - DNA, 471 bp, Homo sapiens; identical to SEQ ID NO: 537461
  misc_feature: HIJSMM301DIWSK.7.81.H04.1.454.light.4.raw

SEQ ID NO: 598851 - DNA, 504 bp, Homo sapiens
  misc_feature: HIJSMM301D0OKI.27.78.H01.1.454.light.4.raw
  modified_base (495)..(495): a, c, t, g, unknown or other
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggatacatttcaccctcaccatcaatagcctggaagctgaagatgctgcaacttattactgtcatcagagtactactttacctcaagtgatcaccttcggccaagggacacgactgganattaaaacg

SEQ ID NO: 598852 - DNA, 510 bp, Homo sapiens
  misc_feature: HIJSMM301D612M.15.34.D01.1.454.light.4.raw
tctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtgggcgtggcatttgggtgttcggcggagggaccaaactgaccgtcctaggtcagcccaaggctgccccctcggtcactctcg

SEQ ID NO: 598853 - DNA, 521 bp, Homo sapiens; identical to SEQ ID NO: 538715
  misc_feature: HIJSMM301C239G.27.23.C01.1.454.light.4.raw

SEQ ID NO: 598854 - DNA, 509 bp, Homo sapiens
  misc_feature: HIJSMM301B1NOX.17.87.H10.1.454.light.4.raw
cgtagactagcacgaccggtgctcgatttagcagtactgcgttggggtttggggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccaacaccacccagacaaagcccccaaactcatcctttatgagggcactaagcggccctcaggggtttctaatcgcttcgctggctccacgtctggcagcacggcctccctgacaatctctgggctccaggctgaggacgaggctgattattactgctgctcatattcaagtcgtgtcactatgatttttggcggaggcaccaaggtgaccgtcctaggtcagcccaaggctgccccctcggtcta

SEQ ID NO: 598855 - DNA, 477 bp, Homo sapiens
  misc_feature: HIJSMM301EJ2G0.48.68.G02.1.454.light.4.raw
  modified_base (447)..(447): a, c, t, g, unknown or other
agtatacatacacgaccggtgctcgatttagtcgatagtgaagggaaaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttatcactatgtctcctggtaccaacagcaccctggcaaagcccccaaactcatgatttatgatatcactaagcggccctcaggggtccctgatcgcttctctggctcccagtctggcaacacggcctccctgaccatctctgggctccaggctgaggatgaggctgattattactgctgctcatatgcaggcagctacacttttggngttcggcggagggaccaagctgactgtcct

SEQ ID NO: 598856 - DNA, 486 bp, Homo sapiens; identical to SEQ ID NO: 535458
  misc_feature: HIJSMM301D82E5.7.75.G09.1.454.light.4.raw

SEQ ID NO: 598857 - DNA, 501 bp, Homo sapiens
  misc_feature: HIJSMM301EDIHO.48.23.C01.1.454.light.4.raw
  modified_base (237)..(237): a, c, t, g, unknown or other
agtatacatacacgaccggtgctcgatttagtacacgtgattagggattgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatntgcttattggtaccagcagaagtcaggccaggcccctgtgctggtcatctttgaggacaacaaacgaccctccgggatccctgagagattctctggctccagctcagggacaatggccaccttgactatcaatggggccaggtggacgatgaggctgactactactgttcctcaacagacagtagtggtgatcgagggctgttcggcggagggaccaagctgaccgtcctaagtcagcccaaggctgccccctggtcactctcg

SEQ ID NO: 598858 - DNA, 447 bp, Homo sapiens; identical to SEQ ID NO: 535020
  misc_feature: HIJSMM301DMI6K.18.9.A09.1.454.light.4.raw

SEQ ID NO: 598859 - DNA, 501 bp, Homo sapiens; identical to SEQ ID NO: 536142
  misc_feature: HIJSMM301A02TD.15.1.A01.1.454.light.4.raw

SEQ ID NO: 598860 - DNA, 515 bp, Homo sapiens; identical to SEQ ID NO: 538805
  misc_feature: HIJSMM301ATLGK.14.19.B08.1.454.light.4.raw

SEQ ID NO: 598861 - DNA, 490 bp, Homo sapiens
  misc_feature: HIJSMM301A42AC.5.47.E03.1.454.light.4.raw
atcagacacgcacgaccggtgctcgatttagactcgcgcacagagagaagggggaagagctgctcagttaggacccagagggaaccatggaaaccccagcgcagcatctcttcctcctgctactctggctcccagataccgccggagaaattgtgttgacgcagtctccaggcaccctgtctttgtctccaggagaaagagccaccctctcctgcagggccagtcagagtgttagcggcgactacttagcctggtaccagcagaaacctggccagactcccaggctcctcatctttggtgtatccagcagggccactggcatcccacgtaggttcagtggcagtgggtctgggacagacttcactctcaccatcagcagactggagcctgaagattttgcagtgtattactgtcagcagtatgggctctcaccttttcacttttcggcggaggaccaaggtggagaacaaacgaactgtggctgcaccat

SEQ ID NO: 598862 - DNA, 495 bp, Homo sapiens
  misc_feature: HIJSMM301BHHU2.49.57.F02.1.454.light.4.raw
agtcgagagacacgaccggtgctcgatttagctcgatatagttgggtttgggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtcttggtggtatataaagacagtgagaggccctcagggatccctgagcgattctctggctccagctcagggacaacagtcacgttgaccatcagtggagtccaggcagaagacgaggctgactattattgtcaatcagcagacaccggtggtacttatcgggtgttcggcggagggaccaagctgaccgtcctaggtcagcccaaggctgccccctcggt

SEQ ID NO: 598863 - DNA, 503 bp, Homo sapiens; identical to SEQ ID NO: 588003
  misc_feature: HIJSMM301C0QWK.21.22.B11.1.454.light.4.raw

SEQ ID NO: 598864 - DNA, 502 bp, Homo sapiens
  misc_feature: HIJSMM301DYCGN.4.59.F04.1.454.light.4.raw
agcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcaccttctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaactgaccgtcctaggtcagcccaaggctgccccctcggtcactc

SEQ ID NO: 598865 - DNA, 497 bp, Homo sapiens; identical to SEQ ID NO: 535286
  misc_feature: HIJSMM301AO9BL.18.59.F04.1.454.light.4.raw

SEQ ID NO: 598866 - DNA, 498 bp, Homo sapiens
  misc_feature: HIJSMM301EJT65.3.33.C11.1.454.light.4.raw
agacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtcttccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctc

SEQ ID NO: 598867 - DNA, 484 bp, Homo sapiens; identical to SEQ ID NO: 544700
  misc_feature: HIJSMM301BO8A1.41.78.H01.1.454.light.4.raw

SEQ ID NO: 598868 - DNA, 487 bp, Homo sapiens
  misc_feature: HIJSMM301AXLR1.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatcttttatgtcttcggatctgggaccagggtcaccgtcctaggtcagcccaaggccaaccca

SEQ ID NO: 598869 - DNA, 508 bp, Homo sapiens
  misc_feature: HIJSMM301CXCFD.5.60.F05.1.454.light.4.raw
atcagacacgcacgaccggtgctcgatttagtacgtcatcagggaaaggggcagcttcagctgtgggtagagaagacaggactcgggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcacctcagcctcctggccatccgtgggctccagtctgaggatgagtctgattattactgtgcaacatgggatgacagcctgaatggtccggtattcggcggagggaccaagctgaccgtcctcggtcagcccaaggctgccccctc

SEQ ID NO: 598870 - DNA, 494 bp, Homo sapiens
  misc_feature: HIJSMM301B8Y3M.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggcagtttattactgtcagcagtattatactactcctctgacgttcggccaagggaccaaggtgaggatcaaacgaactgtggctgcaccat

SEQ ID NO: 598871 - DNA, 505 bp, Homo sapiens; identical to SEQ ID NO: 535503
  misc_feature: HIJSMM301AW6WZ.8.28.C06.1.454.light.4.raw

SEQ ID NO: 598872 - DNA, 482 bp, Homo sapiens
  misc_feature: HIJSMM301CO09D.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgaagattttgctagtttattactgtcagcactataataactggcctccgtacagttttggccaggggaccaagcgtggagatcaaacgaa

SEQ ID NO: 598873 - DNA, 490 bp, Homo sapiens
  misc_feature: HIJSMM301B5D1F.11.81.H04.1.454.light.4.raw
  modified_base (403)..(403): a, c, t, g, unknown or other
cgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagttttttacngtcagcagtatagtaactggcctcgtacacttttggccaggggaccagctagaaatcaaacgaactgtggctgcaccatctgtcttc

SEQ ID NO: 598874 - DNA, 495 bp, Homo sapiens; identical to SEQ ID NO: 546624
  misc_feature: HIJSMM301EH43Y.52.38.D05.1.454.light.4.raw

SEQ ID NO: 598875 - DNA, 508 bp, Homo sapiens; identical to SEQ ID NO: 536388
  misc_feature: HIJSMM301BM729.11.57.F02.1.454.light.4.raw

SEQ ID NO: 598876 - DNA, 545 bp, Homo sapiens
  misc_feature: HIJSMM301EZ52R.7.85.H08.1.454.light.4.raw
  modified_base (390)..(390): a, c, t, g, unknown or other
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccgcaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaaacacagcctccctgaccattactggaccctacgacncgtaggacggacggacgtcgacgtacttaacttacgtcgtcctacgcgactagggtacgggaacgacgggcccggtcctacggacgttaacttgttcgttcggtaaccgtacggtccggaccgtaccgttccgtacggtacgtacgaccgaaccc

SEQ ID NO: 598877 - DNA, 464 bp, Homo sapiens; identical to SEQ ID NO: 537111
  misc_feature: HIJSMM301BV4VW.17.28.C06.1.454.light.4.raw

SEQ ID NO: 598878 - DNA, 489 bp, Homo sapiens; identical to SEQ ID NO: 536013
  misc_feature: HIJSMM301A5YO1.26.23.C01.1.454.light.4.raw

SEQ ID NO: 598879 - DNA, 481 bp, Homo sapiens; identical to SEQ ID NO: 535993
  misc_feature: HIJSMM301B8GPD.21.25.C03.1.454.light.4.raw

SEQ ID NO: 598880 - DNA, 507 bp, Homo sapiens; identical to SEQ ID NO: 563344
  misc_feature: HIJSMM301DCSGP.3.79.H02.1.454.light.4.raw

SEQ ID NO: 598881 - DNA, 519 bp, Homo sapiens
  misc_feature: HIJSMM301AGAR5.51.27.C05.1.454.light.4.raw
cgatcgtatacacgaccggtgctcgatttagacgcgatcgaagggtttggggggggtcgtcaggaggcagcgctctcgggacgtctccaccatggcctgggctctgctattcctcaccctcctcactcagggcacagggtcctgggcccacgtctgccctgactcagcctgcctccgtgtctgggtctcctggacagtcgatcaccatctcctgcactggaaccagcagtgacgttggtggttataattatgtctcctggtaccaacaccacccaggcaaagcccccaaactcatgatttatgatgtcagtgatcggccctcaggggtttcgaatcgcttctctggctccaagtccggcaacacggcctccctgaccatctctgggctccaggccgaggacgaggctgattattactgcacctcatatacaagcagcaacaattgggtgttcggcggagggaccaagctgaccgtcctaggtcagcccaaggctgccccctcggtcactctgttccccg

SEQ ID NO: 598882 - DNA, 445 bp, Homo sapiens
  misc_feature: HIJSMM301BJDAK.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacacgcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggacaaggtcaccgtctaagtcagccaaggccaaccctctgtcactctcgttcccaccctcctccatactcgta

SEQ ID NO: 598883 - DNA, 508 bp, Homo sapiens; identical to SEQ ID NO: 549157
  misc_feature: HIJSMM301CVP8Y.17.33.C11.1.454.light.4.raw

SEQ ID NO: 598884 - DNA, 498 bp, Homo sapiens
  misc_feature: HIJSMM301AW7OR.43.66.F11.1.454.light.4.raw
tgtgagtagtcacgaccggtgctcgatttagtcacgcgagaaggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccg

SEQ ID NO: 598885 - DNA, 498 bp, Homo sapiens
  misc_feature: HIJSMM301DF23Y.52.36.D03.1.454.light.4.raw
cgcagtacgacacgaccggtgctcgatttagctgcgtcacgatctctcttggggtgtgggctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtactggggaaaattatgctgactggtaccagcagaagccaggccaagcccctgagttggtgatatacgaaaatagtgagcgctaccctgggatccctgaccgattctctgggtccacctcagggaagacgaccaccctgaccatcaacagggtccggactgaagacgaggctgactattactgcttgtctggggatgaggacacattggtgttcggcggagggaccaagctgaccgtcctacgtcagcccaaggctgccccctcggtcactctcg

SEQ ID NO: 598886 - DNA, 484 bp, Homo sapiens
  misc_feature: HIJSMM301A0KS5.49.50.E06.1.454.light.4.raw
agtcgagagacacgaccggtgctcgatttagatctactgacaacacacaagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactatttaaattggtatcagcagaaaccagggaaagcccctaaactcctgatctacgatgcatccaatttggagacaggggtcccatcaaggttcagtggaagtggatctgggacacattttacttcaccatcagcggcctgcagcctgaagatttgcaacatattactgtcaaacagtatgaagatctcccactcactttcggcggagggaccgaaggtggagagtcagacgaaactgtggcgtgca

SEQ ID NO: 598887 - DNA, 496 bp, Homo sapiens; identical to SEQ ID NO: 535109
  misc_feature: HIJSMM301BQ9CO.16.78.H01.1.454.light.4.raw

SEQ ID NO: 598888 - DNA, 493 bp, Homo sapiens; identical to SEQ ID NO: 544835
  misc_feature: HIJSMM301BZTE4.43.29.C07.1.454.light.4.raw

SEQ ID NO: 598889 - DNA, 522 bp, Homo sapiens
  misc_feature: HIJSMM301AQ7NO.41.19.B08.1.454.light.4.raw
  modified_base (515)..(515): a, c, t, g, unknown or other
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatcctccggcctccaggcggaggacgaggggtgattatttctgcagctcatttacaaccagccacaccttgctcttcggaactgggaccacggtcatcgtcctaggtcagcccaaggccaaccccactgtcactctgttcccnccctcct

SEQ ID NO: 598890 - DNA, 487 bp, Homo sapiens; identical to SEQ ID NO: 551285
  misc_feature: HIJSMM301EVBN0.3.10.A10.1.454.light.4.raw

SEQ ID NO: 598891 - DNA, 502 bp, Homo sapiens; identical to SEQ ID NO: 559615
  misc_feature: HIJSMM301BHFS2.21.81.H04.1.454.light.4.raw

SEQ ID NO: 598892 - DNA, 511 bp, Homo sapiens
  misc_feature: HIJSMM301CHO0U.3.87.H10.1.454.light.4.raw
agacgcactccacgaccggtgctcgatttagcagtactgcgttgggtttggggggggtctcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccagcagtgacgttggtagatataattatgtctcctggtaccaacaactcccaggcaaagcccccaaactgatgatttatgatgtcaataatcggccctcaggggtttctaatcgcttctctggctccaagtctggtaacacggcctccctgaccatctctgggctccagggtgaggacgaggctgattattactgcagctcatttacaagcagcaccactcaggtcttcggaactgggactaaggtcacgtcctaggtcagcccaaggccaaccccactgtcactctcg

SEQ ID NO: 598893 - DNA, 496 bp, Homo sapiens
  misc_feature: HIJSMM301A0RDD.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcgaatatggtaggtcacctgggacttttggccaggggaccaagctggagatcaaacgaactgtggctgcaccatctgtctt

SEQ ID NO: 598894 - DNA, 493 bp, Homo sapiens
  misc_feature: HIJSMM301COXYY.8.10.A10.1.454.light.4.raw
ctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaagagccaccctctcctgcagggccagtcttagtgttagcaacttagcctggtaccaacagaaacctggccaggctcccaggctcctcatctctgatacatccaacagggccactggcatcccagccaggttcagtggcagtgggtctgggacagacttcactctcaccatcagcagcctagagcctgaagattttgcactttattactgtcagcagcgtagtaactggcctttcaccttcggcctcgggaccaagtggatatcaaacgaactgtgctgcacatctgtctcatcttcccgcact

SEQ ID NO: 598895 - DNA, 511 bp, Homo sapiens
  misc_feature: HIJSMM301DWN4K.8.42.D09.1.454.light.4.raw
ctcgcgtgtccacgaccggtgctcgatttagacacatacgcaggggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgtattttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgacgtcctaggtcagcccaaggctgccccctcggtcactctgttcccgccctcccg

SEQ ID NO: 598896 - DNA, 489 bp, Homo sapiens; identical to SEQ ID NO: 535139
  misc_feature: HIJSMM301ANOT8.14.55.E11.1.454.light.4.raw

SEQ ID NO: 598897 - DNA, 487 bp, Homo sapiens
  misc_feature: HIJSMM301BNQ74.14.53.E09.1.454.light.4.raw
cgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgcttttttggaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggagggaccaagctgaccgtcctaggtcagcccaaggctgccccctcggtctacc

SEQ ID NO: 598898 - DNA, 505 bp, Homo sapiens
  misc_feature: HIJSMM301E0MQV.3.79.H02.1.454.light.4.raw
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggtatttggtggaggaccaagctgaccgtctaggtcagcccaaggctcgccccctcggt

SEQ ID NO: 598899 - DNA, 502 bp, Homo sapiens
  misc_feature: HIJSMM301BSLBT.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtctaggtcagcccaaggctgcccccc

SEQ ID NO: 598900 - DNA, 501 bp, Homo sapiens; identical to SEQ ID NO: 579640
  misc_feature: HIJSMM301DTZ5U.9.81.H04.1.454.light.4.raw

SEQ ID NO: 598901 - DNA, 519 bp, Homo sapiens; identical to SEQ ID NO: 541985
  misc_feature: HIJSMM301A5XCL.41.25.C03.1.454.light.4.raw

SEQ ID NO: 598902 - DNA, 505 bp, Homo sapiens; identical to SEQ ID NO: 535503
  misc_feature: HIJSMM301DWA4J.8.28.C06.1.454.light.4.raw

SEQ ID NO: 598903 - DNA, 493 bp, Homo sapiens; identical to SEQ ID NO: 540179
  misc_feature: HIJSMM301E1IKK.27.78.H01.1.454.light.4.raw

SEQ ID NO: 598904 - DNA, 467 bp, Homo sapiens; identical to SEQ ID NO: 549483
  misc_feature: HIJSMM301C4U33.48.48.E04.1.454.light.4.raw

SEQ ID NO: 598905 - DNA, 506 bp, Homo sapiens; identical to SEQ ID NO: 534969
  misc_feature: HIJSMM301DOC07.18.37.D04.1.454.light.4.raw

SEQ ID NO: 598906 - DNA, 453 bp, Homo sapiens
  misc_feature: HIJSMM301AT62B.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggtttcggcggagggaccaagctgaccgtcctaagtcagcccaaggctgccccctcggtcactctgttcccaccctcctccacgagagta

SEQ ID NO: 598907 - DNA, 490 bp, Homo sapiens
  misc_feature: HIJSMM301A6H3S.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggtccgaacgggaccgaaggtaggaaagtacaaacgaactagtggcgtgcaccta

SEQ ID NO: 598908 - DNA, 492 bp, Homo sapiens
  misc_feature: HIJSMM301D39CZ.41.68.G02.1.454.light.4.raw
tctatactatcacgaccggtgctcgatttagtcgatagtgaagggaaagggcacgaccggtgctcgatttagtcgatagtgaagggaaagggggagtcagtcccaaccaggacacagcatggacatgagggtccctgctcagctcctggggctcctgctgctctggctctcaggtgccagatgtgacatccagatgacccagtctccaacctccctgtctgcatctgtaggagacagagtcaccatcacttgccaggccagtcaggacattagcaactatttaaattggtatcagcagaaaccagggaaagcccctaagctcctgatctacgatgcatccaatttggaatcaggggtcccatcaaggttcagtggaagtggatctgggacagattttactttcaccatcaccagcctgcagcctgaagatattgcaacatattactgtcaacagtatgataatctccctcccactttcggcggagggaccaa

SEQ ID NO: 598909 - DNA, 501 bp, Homo sapiens
  misc_feature: HIJSMM301DVXB5.12.67.G01.1.454.light.4.raw
atacgacgtacacgaccggtgctcgatttagagtatacatattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcagagcccccaaactcatgatttttgatgtcactaatcggccctcaggggtttctgatcgcttctctggctccaagtctgactacacggcctccctgaccatctctgggctccaggctgaggacgaggctgattattattgcagctcatatacaagcagcagcaccctctttgtcttggaagtgggaccaaggtcaccgtcctacgtcagcccaaggccaaccca

SEQ ID NO: 598910 - DNA, 509 bp, Homo sapiens; identical to SEQ ID NO: 535670
  misc_feature: HIJSMM301DPDX9.47.23.C01.1.454.light.4.raw

SEQ ID NO: 598911 - DNA, 495 bp, Homo sapiens; identical to SEQ ID NO: 538269
  misc_feature: HIJSMM301B6CG8.9.1.A01.1.454.light.4.raw

SEQ ID NO: 598912 - DNA, 505 bp, Homo sapiens
  misc_feature: HIJSMM301DL4HN.8.42.D09.1.454.light.4.raw
ctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctcggtcactctgttcccacct

SEQ ID NO: 598913 - DNA, 489 bp, Homo sapiens
  misc_feature: HIJSMM301CHY5H.49.34.D01.1.454.light.4.raw
agtcgagagacacgaccggtgctcgatttagatcgtctgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaaacagtcacgttgaccatcagtggagtccgggcgagaggacgaggctgactattactgtcagtcatcagacagtagtggcacttctgtcgtattcggcggagggaccaagctgaccgtcctaggtcagcccaaggctccg

SEQ ID NO: 598914 - DNA, 507 bp, Homo sapiens
  misc_feature: HIJSMM301EMI9G.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctcgggaccaaaattagagatcaaacgaactgtggctgcaccatctgtcttctatcttcccgcc

SEQ ID NO: 598915 - DNA, 514 bp, Homo sapiens; identical to SEQ ID NO: 545978
  misc_feature: HIJSMM301A6TJT.17.33.C11.1.454.light.4.raw

SEQ ID NO: 598916 - DNA, 495 bp, Homo sapiens; identical to SEQ ID NO: 541828
  misc_feature: HIJSMM301E0AGH.19.71.G05.1.454.light.4.raw

SEQ ID NO: 598917 - DNA, 517 bp, Homo sapiens
  misc_feature: HIJSMM301BPHFW.43.19.B08.1.454.light.4.raw
tgtgagtagtcacgaccggtgctcgatttagtgagtcagtaagggggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagccgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgtccccccg

SEQ ID NO: 598918 - DNA, 485 bp, Homo sapiens; identical to SEQ ID NO: 536307
  misc_feature: HIJSMM301AZKVQ.46.35.D02.1.454.light.4.raw

SEQ ID NO: 598919 - DNA, 514 bp, Homo sapiens; identical to SEQ ID NO: 541418
  misc_feature: HIJSMM301AOZUV.17.33.C11.1.454.light.4.raw

SEQ ID NO: 598920 - DNA, 463 bp, Homo sapiens; identical to SEQ ID NO: 535062
  misc_feature: HIJSMM301C0V5K.11.73.G07.1.454.light.4.raw

SEQ ID NO: 598921 - DNA, 476 bp, Homo sapiens
  misc_feature: HIJSMM301BHB4U.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgtattttgctaacttactactgtcaacagagttccactaccccaatctacttcggcctggactgaagtgcatatgaagagaactgtggctgca

SEQ ID NO: 598922 - DNA, 513 bp, Homo sapiens; identical to SEQ ID NO: 539258
  misc_feature: HIJSMM301DDZVP.43.19.B08.1.454.light.4.raw

SEQ ID NO: 598923 - DNA, 500 bp, Homo sapiens
  misc_feature: HIJSMM301AK9IE.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccaaggaccgaaggtaggaacgtcaaacgaactagtggcgtg

SEQ ID NO: 598924 - DNA, 491 bp, Homo sapiens; identical to SEQ ID NO: 535176
  misc_feature: HIJSMM301DNXFM.13.39.D06.1.454.light.4.raw

SEQ ID NO: 598925 - DNA, 487 bp, Homo sapiens
  misc_feature: HIJSMM301DBFYB.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggaatatcagacgaa

SEQ ID NO: 598926 - DNA, 512 bp, Homo sapiens; identical to SEQ ID NO: 552536
  misc_feature: HIJSMM301B4SXN.17.33.C11.1.454.light.4.raw

SEQ ID NO: 598927 - DNA, 486 bp, Homo sapiens; identical to SEQ ID NO: 537238
  misc_feature: HIJSMM301EOKG8.19.71.G05.1.454.light.4.raw

SEQ ID NO: 598928 - DNA, 505 bp, Homo sapiens
  misc_feature: HIJSMM301C6UY8.19.85.H08.1.454.light.4.raw
tactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagcccaaggcctcgccccctcggt

SEQ ID NO: 598929 - DNA, 520 bp, Homo sapiens
  misc_feature: HIJSMM301BATDT.40.87.H10.1.454.light.4.raw
tctagcgactcacgaccggtgctcgatttagcagtactgcgttgggtttgggggggaagctcagcttcagctgtggtagagaagacgggattcaggacaatctccagcatggccggcttccctctcctcctcaccctcctcactcactgtgcagggtcctgggcccagtctgtgctgactcagccaccctcagcgtctgggacccccgggcagagggtcaccatttcttgttctggaagcaactccaatatcggaactaattatgtatactggtaccagcagctcccaggaacggcccccaaagtcctcttctataggaataatcaacggccctcaggggtccctgaccgattctctgcctccaagtctggcacctctgtgtccctggccatcagtgggctccggtccgaagatgagggtgactattactgtgcagcttgggatgagagcctgagaggttggctggttcggcgggaggaccaagctgaccgtctagtcagcccaagctcgccccctcggt

SEQ ID NO: 598930 - DNA, 497 bp, Homo sapiens
  misc_feature: HIJSMM301BCWH7.48.37.D04.1.454.light.4.raw
agtatacatacacgaccggtgctcgatttagtagcatactgttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtctaggtcagcccaaggctcg

SEQ ID NO: 598931 - DNA, 518 bp, Homo sapiens
  misc_feature: HIJSMM301DWCV5.8.33.C11.1.454.light.4.raw
ctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtcggccgtccggggccacgtttcggtcccgtgggaccgaaggtaggagatacaaacgaactcgtggcgtgcgaccactctgtcttcta

SEQ ID NO: 598932 - DNA, 494 bp, Homo sapiens; identical to SEQ ID NO: 543077
  misc_feature: HIJSMM301B38SB.15.26.C04.1.454.light.4.raw

SEQ ID NO: 598933 - DNA, 497 bp, Homo sapiens; identical to SEQ ID NO: 537288
  misc_feature: HIJSMM301EEL7X.15.25.C03.1.454.light.4.raw

SEQ ID NO: 598934 - DNA, 502 bp, Homo sapiens; identical to SEQ ID NO: 536253
  misc_feature: HIJSMM301CA0JP.21.22.B11.1.454.light.4.raw

SEQ ID NO: 598935 - DNA, 494 bp, Homo sapiens; identical to SEQ ID NO: 534994
  misc_feature: HIJSMM301B7MT7.27.78.H01.1.454.light.4.raw

SEQ ID NO: 598936 - DNA, 484 bp, Homo sapiens
  misc_feature: HIJSMM301DDHTX.10.1.A01.1.454.light.4.raw
catagtagtgcacgaccggtgctcgatttagacgtctcatcaggggtccaaacagagcttcagcaagcatagtgggaatctgcaccatgccctgggctctgctcctcccgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatgggacaccggcctcagtgcgtgggttttcggcggagggaccaagctgaccgtcctaggtcagcccaa

SEQ ID NO: 598937 - DNA, 494 bp, Homo sapiens; identical to SEQ ID NO: 546380
  misc_feature: HIJSMM301A1SVU.53.5.A05.1.454.light.4.raw

SEQ ID NO: 598938 - DNA, 517 bp, Homo sapiens
  misc_feature: HIJSMM301C7PVT.13.55.E11.1.454.light.4.raw
tcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtggccccgggacagacggccacaattccctgtgagggaaacaaccttagaagtcagaatgtccactggtaccagcagaagtcaggccaggcccctgtggtggtcatctatagggataataaccggccctctgggatccctgaccgattctctggctccaactcggggaacacggccaccctgaccatcaacagagcccaagacggggatgaggctgactattattgtcaggtgtgggacagcaccacggtgatattcggcggcgggaccaagctgaccgtcctaggtcagcccaaggctgccccctcggtcactctgttcccgccctcctcct

SEQ ID NO: 598939 - DNA, 491 bp, Homo sapiens; identical to SEQ ID NO: 550287
  misc_feature: HIJSMM301B12U0.14.36.D03.1.454.light.4.raw

SEQ ID NO: 598940 - DNA, 498 bp, Homo sapiens; identical to SEQ ID NO: 538056
  misc_feature: HIJSMM301AWR6L.15.25.C03.1.454.light.4.raw

SEQ ID NO: 598941 - DNA, 487 bp, Homo sapiens; identical to SEQ ID NO: 536206
  misc_feature: HIJSMM301ELS6F.47.38.D05.1.454.light.4.raw

SEQ ID NO: 598942 - DNA, 516 bp, Homo sapiens
  misc_feature: HIJSMM301BQHS3.15.76.G10.1.454.light.4.raw
tctacgtagccacgaccggtgctcgatttagtcactcatacagggggcgccagggtcccgttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaagctgccctgacactgtctggtgtgcagcctgaggacgaggctgactattactgcctactctactttggtggtgctgtgctattcggcggagggaccaagctgaccgtcttaagtcagcccaaggctgccccctccgggtcacctctgttccccaccctcctcgctacgg

SEQ ID NO: 598943 - DNA, 500 bp, Homo sapiens
  misc_feature: HIJSMM301BNDXM.41.49.E05.1.454.light.4.raw
tctatactatcacgaccggtgctcgatttagagcgactagcaacacacaaagggggaggaactgctcagttaggacccagagggaaccatggaagccccagctcagcttctcttcctcctgctactctggctcccagataccaccggagaaattgtgttgacacagtctccagccaccctgtctctgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagaacctgaagattttgcaattttattactgtcagcagcgtatcaactggcctccgtggacgttcggccgaaggaccgaaggtggaaatacaaacgaactagtggctgcaccatctgtt

SEQ ID NO: 598944 - DNA, 508 bp, Homo sapiens
  misc_feature: HIJSMM301CEWQV.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgttcctattcggcggagggaccaagctgaccgtcctgggtcagcccaacggctcgccccctcggtccactctgttcccaccctcctctactcgtat

SEQ ID NO: 598945 - DNA, 489 bp, Homo sapiens
  misc_feature: HIJSMM301BB9IT.21.55.E11.1.454.light.4.raw
tcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattatttgccggacaagtcacgacataaacaccttttttaaattggtatcagcacaaaccagggaaggccccaaagctcctgatcgatgctgcatccaatttagagagtggggtcccatccaggttcagtggcgatggatctgggacaaatttcactctcaccatcagcagtctgcaacctgaagattttgcaacttactattgtcaacagagttacagtattcctttcactttcggccctgggaccgaagtcgatatcaaacgactgtggctgcaccatctgtt

SEQ ID NO: 598946 - DNA, 483 bp, Homo sapiens; identical to SEQ ID NO: 593904
  misc_feature: HIJSMM301DR3HJ.41.34.D01.1.454.light.4.raw

SEQ ID NO: 598947 - DNA, 447 bp, Homo sapiens; identical to SEQ ID NO: 535020
  misc_feature: HIJSMM301EHLKS.18.9.A09.1.454.light.4.raw

SEQ ID NO: 598948 - DNA, 520 bp, Homo sapiens; identical to SEQ ID NO: 543998
  misc_feature: HIJSMM301D9T5C.27.23.C01.1.454.light.4.raw

SEQ ID NO: 598949 - DNA, 501 bp, Homo sapiens; identical to SEQ ID NO: 536818
  misc_feature: HIJSMM301BZG9Z.12.82.H05.1.454.light.4.raw

SEQ ID NO: 598950 - DNA, 504 bp, Homo sapiens; identical to SEQ ID NO: 535561
  misc_feature: HIJSMM301CZD72.4.57.F02.1.454.light.4.raw

SEQ ID NO: 598951 - DNA, 505 bp, Homo sapiens; identical to SEQ ID NO: 557888
  misc_feature: HIJSMM301CTMD2.5.24.C02.1.454.light.4.raw

SEQ ID NO: 598952 - DNA, 513 bp, Homo sapiens
  misc_feature: HIJSMM301C6L5H.7.34.D01.1.454.light.4.raw
cgtgtctctacacgaccggtgctcgatttagatcgtctgtgttgggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacagcattatttgggtgttcggcggagggaccaaggctgaccgtcctgcgtcagcccaaggctgccccctggtcactcc

SEQ ID NO: 598953 - DNA, 493 bp, Homo sapiens; identical to SEQ ID NO: 571339
  misc_feature: HIJSMM301AQYW5.10.72.G06.1.454.light.4.raw

SEQ ID NO: 598954 - DNA, 508 bp, Homo sapiens; identical to SEQ ID NO: 552440
  misc_feature: HIJSMM301CP9YM.5.24.C02.1.454.light.4.raw

SEQ ID NO: 598955 - DNA, 493 bp, Homo sapiens
  misc_feature: HIJSMM301CTZIQ.51.71.G05.1.454.light.4.raw
cgatcgtatacacgaccggtgctcgatttagtgtcgtcgcaagagagagggggggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcact

SEQ ID NO: 598956 - DNA, 511 bp, Homo sapiens
  misc_feature: HIJSMM301C8QM8.22.36.D03.1.454.light.4.raw
acatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccaactcatcatttatggtgtcactcgtcggccctcaggagtctctcatcgcttctcaggctccaagtctggcaacacggcctcctaaccatctctgggctccagtttgaggacgagtctacttattactgcagttcctttaaattaggcgccactctcgtggttttcggcggaggcaccgaagtgaccgtcctcggtcagtccaaggctgccccctcggtcact

SEQ ID NO: 598957 - DNA, 496 bp, Homo sapiens; identical to SEQ ID NO: 535109
  misc_feature: HIJSMM301B4SQE.16.78.H01.1.454.light.4.raw

SEQ ID NO: 598958 - DNA, 489 bp, Homo sapiens
  misc_feature: HIJSMM301A2R8U.8.12.B01.1.454.light.4.raw
ctcgcgtgtccacgaccggtgctcgatttagtagtgtagattccgcggggctgggcctcaggaagcagcatcggaggcgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggccctcagggatccctgagcgattctctggctccaactctgggaacacagccactctgaccatcagcgggacccaggctacggatgaggctgactattactgtcaggcgtgggacagcagcaacctatgtggttttcggcggagggaccaagctgaccgtccttggtcagcccaaggctgccccccg

SEQ ID NO: 598959 - DNA, 508 bp, Homo sapiens
  misc_feature: HIJSMM301ETZ9Z.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctggaccaaggtggagatcaaacgaaactgtggctgcaccatctgtcttcta

SEQ ID NO: 598960 - DNA, 504 bp, Homo sapiens; identical to SEQ ID NO: 552234
  misc_feature: HIJSMM301B1838.22.21.B10.1.454.light.4.raw

SEQ ID NO: 598961 - DNA, 492 bp, Homo sapiens
  misc_feature: HIJSMM301ALKAJ.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatggttggtagtttattactgcatgcaagctctacaactacctctcactttcggcggagggaccgaaggtggagatacaaacgaactgtt

SEQ ID NO: 598962 - DNA, 448 bp, Homo sapiens; identical to SEQ ID NO: 540567
  misc_feature: HIJSMM301ASB4I.18.9.A09.1.454.light.4.raw

SEQ ID NO: 598963 - DNA, 524 bp, Homo sapiens
  misc_feature: HIJSMM301AMMT8.17.28.C06.1.454.light.4.raw
  modified_base (469)..(469): a, c, t, g, unknown or other
cgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatccggcccccgactcctcatctatagaaatgatcatccggccctccggggtccctgaccgattctctggctccatgtctggcacctcagccctccctgaccatcagtgggctccggtccgaggatgaggctgattattactgtgcaccgtgggatgacatcctgaatcgggttccggtggttcggngggacgggaccagggctgacccgtcctaagtcacgcccaagggctcgtccccccg

SEQ ID NO: 598964 - DNA, 488 bp, Homo sapiens; identical to SEQ ID NO: 535081
  misc_feature: HIJSMM301BTEMF.26.23.C01.1.454.light.4.raw

SEQ ID NO: 598965 - DNA, 498 bp, Homo sapiens
  misc_feature: HIJSMM301C24M0.51.49.E05.1.454.light.4.raw
cgatcgtatacacgaccggtgctcgatttagagcgactagcaacacacaaagggggaggaactgctcagttaggagccagacggaaccatggaagccccagcgcagcttctcttcctcctgctactctggctcccagataccattggagagatagtgctgacgcagtctccagccaccctgtctgtgtctccaggggagagagtcaccctctcctgcagggcctctgagaatatagatatctacttggtctggtaccagcaaaaacctggccagcctcccaggctcctcgtccatagtgcctccgccagggccgctggtgtcccagccaggttccgaggcagtcggtctgggacagagttcactctcaccattaccaacctgcagtctgaagattttggactttattactgtcagcagtataatgactggcctaggacgttcggccaagggaccagggtggaaatcaagcgaactgtggctgcaccatctgtcttcta

SEQ ID NO: 598966 - DNA, 503 bp, Homo sapiens; identical to SEQ ID NO: 535044
  misc_feature: HIJSMM301B3L57.19.78.H01.1.454.light.4.raw

SEQ ID NO: 598967 - DNA, 494 bp, Homo sapiens
  misc_feature: HIJSMM301BUI5U.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactgacatcccagacaggttcagtggcagtgggtctgggacagacttcactctcaccatcagcagactggagcctgaggattttgcagtgtattactgtcagcagtatcatagttcaaacaccttcggccaagggacacgactggagattaaaggaactgtggctgcaccatctgtcttcatcttccccg

SEQ ID NO: 598968 - DNA, 505 bp, Homo sapiens; identical to SEQ ID NO: 535503
  misc_feature: HIJSMM301CXI37.8.28.C06.1.454.light.4.raw

SEQ ID NO: 598969 - DNA, 487 bp, Homo sapiens; identical to SEQ ID NO: 537573
  misc_feature: HIJSMM301EIZWI.3.10.A10.1.454.light.4.raw

SEQ ID NO: 598970 - DNA, 503 bp, Homo sapiens
  misc_feature: HIJSMM301D0N5E.4.21.B10.1.454.light.4.raw
agcactgtagcacgaccggtgctcgatttagtgtcgtcgcaagagagagagaggggtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcagtgggcccaagtggaggatgaagctgactactactgttactcaatagagaacagtgataatttctgggtgttcggcggagggaccaaactgaccgtcctaggtcagcccaaggctcgcccctcggtcactc

SEQ ID NO: 598971 - DNA, 510 bp, Homo sapiens
  misc_feature: HIJSMM301AOYPI.10.9.A09.1.454.light.4.raw
catagtagtgcacgaccggtgctcgatttagcgagacgcgcaggggcagagccctggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctcgggaccgaaacgtaggaggatacaaacgaactagtggcgtgcacca

SEQ ID NO: 598972 - DNA, 511 bp, Homo sapiens; identical to SEQ ID NO: 548439
  misc_feature: HIJSMM301BEF66.16.46.E02.1.454.light.4.raw

SEQ ID NO: 598973 - DNA, 510 bp, Homo sapiens
  misc_feature: HIJSMM301BU0NP.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctcgggaccaaggtggaggatcaaacgaactgtggctgcaccatctgtcttcta

SEQ ID NO: 598974 - DNA, 511 bp, Homo sapiens; identical to SEQ ID NO: 537464
  misc_feature: HIJSMM301ET1EP.7.34.D01.1.454.light.4.raw

SEQ ID NO: 598975 - DNA, 496 bp, Homo sapiens; identical to SEQ ID NO: 535109
  misc_feature: HIJSMM301A9PDE.16.78.H01.1.454.light.4.raw

SEQ ID NO: 598976 - DNA, 469 bp, Homo sapiens
  misc_feature: HIJSMM301B7YHP.13.76.G10.1.454.light.4.raw
  modified_base (431)..(431): a, c, t, g, unknown or other
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctangtcttcggaactgggaccaaggtcaccgtctaagtcag

SEQ ID NO: 598977 - DNA, 505 bp, Homo sapiens; identical to SEQ ID NO: 538422
  misc_feature: HIJSMM301BVJGO.19.78.H01.1.454.light.4.raw

SEQ ID NO: 598978 - DNA, 486 bp, Homo sapiens
  misc_feature: HIJSMM301AJ231.43.44.D11.1.454.light.4.raw
tgtgagtagtcacgaccggtgctcgatttagcgcagtacgaagggggggtcagacccagtcaggacacaacatgcacatgagggtccccgctcagctcctggggctcctgctgctctggctcccaggtgcccaatgtgacatccaggtgacccagtctccttccaccctgtctgcatctgtcggagacagagtcaccatctcttgccgggccagtcaaagttctgtcaggtggttggcctggtatcagcagaagtcagggcaagcccctaggctcctgatgtttaaggcgtctggttcagagagtgaggccccgtccaggttctctgccagtggatctggaacagaactcacactcatcatccgcagcctgcagcctgatgactttgcaacatattactgccaagagtttgatggtcgtttgtggacgttcggccaagggaccagggtagacgtcaaacgaactgtggctgcaccatctgtcttca

SEQ ID NO: 598979 - DNA, 482 bp, Homo sapiens; identical to SEQ ID NO: 562591
  misc_feature: HIJSMM301A2ISU.49.83.H06.1.454.light.4.raw

SEQ ID NO: 598980 - DNA, 495 bp, Homo sapiens
  misc_feature: HIJSMM301DIWF0.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaacgggaccaaagtaggacatacaagacgaactgtggctgcaccatctgtt

SEQ ID NO: 598981 - DNA, 504 bp, Homo sapiens; identical to SEQ ID NO: 535561
  misc_feature: HIJSMM301DQSS6.4.57.F02.1.454.light.4.raw

SEQ ID NO: 598982 - DNA, 499 bp, Homo sapiens
  misc_feature: HIJSMM301C9PTZ.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcgttcggcggggggaccaagctgaccgtcctaggtcagcccaaggc

SEQ ID NO: 598983 - DNA, 500 bp, Homo sapiens
  misc_feature: HIJSMM301BFRK9.13.11.A11.1.454.light.4.raw
tcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctctgggcgagagggccaccatcaactgcaagaccagccagagtgttttatacagctccgacaataggaactacttagcttggtaccaacagaaaccaggacagcctccgaagttactcttttactgggcgtctacccgggaatccggggtccctgaccgattcagtggcagcgggtctgggacagatttcactctcaccatcagcagccttcaggctgaagatgtggcagtttattactgtcagcaatattatatctctcctcctcggacgttcggccaagggaccagggtggaaatacaaacgaactgtggctgcaccatctgtcttcatcttcccgccat

SEQ ID NO: 598984 - DNA, 488 bp, Homo sapiens; identical to SEQ ID NO: 536861
  misc_feature: HIJSMM301BFLLB.12.88.H11.1.454.light.4.raw

SEQ ID NO: 598985 - DNA, 454 bp, Homo sapiens; identical to SEQ ID NO: 535005
  misc_feature: HIJSMM301D8SMS.19.86.H09.1.454.light.4.raw

SEQ ID NO: 598986 - DNA, 486 bp, Homo sapiens; identical to SEQ ID NO: 535043
  misc_feature: HIJSMM301CL4CZ.46.35.D02.1.454.light.4.raw

SEQ ID NO: 598987 - DNA, 486 bp, Homo sapiens; identical to SEQ ID NO: 565571
  misc_feature: HIJSMM301D26MT.5.6.A06.1.454.light.4.raw

SEQ ID NO: 598988 - DNA, 491 bp, Homo sapiens; identical to SEQ ID NO: 536211
  misc_feature: HIJSMM301EKXN3.16.53.E09.1.454.light.4.raw

SEQ ID NO: 598989 - DNA, 507 bp, Homo sapiens
  misc_feature: HIJSMM301CAP7U.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtcggatatcaaacgaactagtggctgcaccatctgtctt

SEQ ID NO: 598990 - DNA, 505 bp, Homo sapiens
  misc_feature: HIJSMM301AIHL6.19.67.G01.1.454.light.4.raw
tactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagtttattactgtcagcaattatttttcttatcctccgtggacgttcggccaagggaccagggtggaaatcagacgaactgtggctgcaccat

SEQ ID NO: 598991 - DNA, 498 bp, Homo sapiens
  misc_feature: HIJSMM301DZF8C.22.27.C05.1.454.light.4.raw
acatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaaatattatattcctcctcagacgttcggccaagggaccaaggtggaaatcaaacgactgtggctgcacc

SEQ ID NO: 598992 - DNA, 490 bp, Homo sapiens
  misc_feature: HIJSMM301A3TEB.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatccccagccaggttcagtggcagtgggtctgggacagagttcactctcaccatcagcagcctgcagtctgaagattgtgcaatttattactgtcagcaatataatacctggcctccgctcactttcggcggagggaccaaggttgagatcaaacgaactgtggctgcaccta

SEQ ID NO: 598993 - DNA, 491 bp, Homo sapiens
  misc_feature: HIJSMM301A42QB.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagtattttgcagtctattactgtcagcagtatggtcacgtcccaagtaacgttttggccgaggggaccaagctggagatacaaacgaactgtggctgcaccat

SEQ ID NO: 598994 - DNA, 460 bp, Homo sapiens; identical to SEQ ID NO: 540069
  misc_feature: HIJSMM301BQD0H.11.86.H09.1.454.light.4.raw

SEQ ID NO: 598995 - DNA, 506 bp, Homo sapiens
  misc_feature: HIJSMM301A6C5A.18.78.H01.1.454.light.4.raw
tacgagtatgcacgaccggtgctcgatttagtgtgagtagtttgggtttggggggggtctcaggaggcagcgctctcgggacgtctccaccatggcctggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcta

SEQ ID NO: 598996 - DNA, 474 bp, Homo sapiens; identical to SEQ ID NO: 588848
  misc_feature: HIJSMM301EN8LD.11.17.B06.1.454.light.4.raw

SEQ ID NO: 598997 - DNA, 454 bp, Homo sapiens; identical to SEQ ID NO: 535005
  misc_feature: HIJSMM301EDHWB.19.86.H09.1.454.light.4.raw

SEQ ID NO: 598998 - DNA, 494 bp, Homo sapiens
  misc_feature: HIJSMM301AJDIJ.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtctaggtcagcccaaggcccaaccc

SEQ ID NO: 598999 - DNA, 483 bp, Homo sapiens; identical to SEQ ID NO: 573020
  misc_feature: HIJSMM301CLBVF.5.45.E01.1.454.light.4.raw

SEQ ID NO: 599000 - DNA, 503 bp, Homo sapiens
  misc_feature: HIJSMM301CTA62.43.60.F05.1.454.light.4.raw
tgtgagtagtcacgaccggtgctcgatttagtacgtcatcagggaaaggggcaggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccccgtcggtaccgtcgtaccggacgggaaccgtcggtaggagtcgtacgagacgtaacgtggtggcgtcgccacta

SEQ ID NO: 599001 - DNA, 492 bp, Homo sapiens
  misc_feature: HIJSMM301A7K8G.11.81.H04.1.454.light.4.raw
cgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttttactgtcagcagtatagtaactggcctccgtacacttttggccaggggaccaagctagaaatcaaacgactgtggctgcaccatctgtcttcta

SEQ ID NO: 599002 - DNA, 506 bp, Homo sapiens; identical to SEQ ID NO: 534969
  misc_feature: HIJSMM301CN5P5.18.37.D04.1.454.light.4.raw

SEQ ID NO: 599003 - DNA, 501 bp, Homo sapiens; identical to SEQ ID NO: 535746
  misc_feature: HIJSMM301BAVKD.18.11.A11.1.454.light.4.raw

SEQ ID NO: 599004 - DNA, 493 bp, Homo sapiens; identical to SEQ ID NO: 571077
  misc_feature: HIJSMM301BM0KO.16.6.A06.1.454.light.4.raw

SEQ ID NO: 599005 - DNA, 500 bp, Homo sapiens
  misc_feature: HIJSMM301A47WO.7.5.A05.1.454.light.4.raw
cgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccgaatcgcttctctggctccaagtctggcgacacggcctccctcgaccatctctgggctccaggctgaagacgaggctgattattactgcagctcatatacaggcagcagcactcaggttttcggcggagggaccaagctgaccgtcctaggtcagcccaaggctcgccccctccggt

SEQ ID NO: 599006 - DNA, 517 bp, Homo sapiens
  misc_feature: HIJSMM301BHDUD.48.29.C07.1.454.light.4.raw
agtatacatacacgaccggtgctcgatttagagtgctacgaagggaaaggggtggtctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctcggtcactctgttcccaccct

SEQ ID NO: 599007 - DNA, 498 bp, Homo sapiens
  misc_feature: HIJSMM301BEBJF.26.12.B01.1.454.light.4.raw
  modified_base (207)..(207): a, c, t, g, unknown or other
  modified_base (468)..(468): a, c, t, g, unknown or other
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagngtcaccctctcctgcagggccagtcagagtgttagtaacaacttagcctggtaccagcagaaacctggccaggctcccaggctcctcatctctggtgcatccaccagggccactggtactcccggccagattcaggtggcgagggggtctgggacagaattcactctcaccatcaccagcctgcagtctgaagtatttgcagtctattactgtcagcaatataattactgctctcgtttcgggcgggggacaagcgtgganatcaaccgactggtgctcgcaccatctgtt

SEQ ID NO: 599008 - DNA, 498 bp, Homo sapiens; identical to SEQ ID NO: 535295
  misc_feature: HIJSMM301EMH8W.15.25.C03.1.454.light.4.raw

SEQ ID NO: 599009 - DNA, 485 bp, Homo sapiens; identical to SEQ ID NO: 540285
  misc_feature: HIJSMM301EG3NQ.46.26.C04.1.454.light.4.raw

SEQ ID NO: 599010 - DNA, 484 bp, Homo sapiens
  misc_feature: HIJSMM301A5NCG.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccaaactgaccgtcctaggtcagcccaaggctgccccctcggtcactctgttcccgccctcctctacgtgagct

SEQ ID NO: 599011 - DNA, 494 bp, Homo sapiens; identical to SEQ ID NO: 536974
  misc_feature: HIJSMM301EOH5T.16.86.H09.1.454.light.4.raw

SEQ ID NO: 599012 - DNA, 513 bp, Homo sapiens; identical to SEQ ID NO: 536403
  misc_feature: HIJSMM301C2OQ6.17.37.D04.1.454.light.4.raw

SEQ ID NO: 599013 - DNA, 473 bp, Homo sapiens; identical to SEQ ID NO: 538793
  misc_feature: HIJSMM301DUC5H.5.34.D01.1.454.light.4.raw

SEQ ID NO: 599014 - DNA, 516 bp, Homo sapiens
  misc_feature: HIJSMM301CAEPM.49.10.A10.1.454.light.4.raw
agtcgagagacacgaccggtgctcgatttagcgtcgatctcaggggctgggcctaaggaagcagcactggtggtgcctcagccatggcctggaccgttctcctcctcggcctcctctctcactgcacagactctgtgacctcctatgttctgactcagccgccctcggcgtcagtggccccaggacagacggccacgattccctgtaggggagacgacattggagggaaagctgtgcattggtaccagcagaagccaggccaggcccctgagctggtcctccatggtgatagcgaccggccctcagggatccctgagcgattctctggctccaactctgggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgccctcctctctctccg

SEQ ID NO: 599015 - DNA, 507 bp, Homo sapiens; identical to SEQ ID NO: 567373
  misc_feature: HIJSMM301ADX6Z.47.83.H06.1.454.light.4.raw

SEQ ID NO: 599016 - DNA, 497 bp, Homo sapiens
  misc_feature: HIJSMM301EG9T7.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccgaggggaccaagctggagatcaaacgactgtggctgcaccatctgtt

SEQ ID NO: 599017 - DNA, 486 bp, Homo sapiens
  misc_feature: HIJSMM301CLGB3.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggccagggaccaaactggacatacaaacgaactgtgctgcacatctgtt

SEQ ID NO: 599018 - DNA, 491 bp, Homo sapiens
  misc_feature: HIJSMM301C5P8C.49.60.F05.1.454.light.4.raw
agtcgagagacacgaccggtgctcgatttagtacgtcatcagggaaagggggatcaggactcctcagttcacctcctcacaatgaggctccctgctcagctcctggggctgctaatgctctgggtctctggatccagtgggggtattgtgatgactcagtctccactctccctgcccgtcacccctggagagtcggcctccatctcctgcaggtctagtcagagcctcctatatagggatggatacaactatttggattggtacgtgcagaagccagggaagcctccacagctcctgatctatctggcttctaatcgggcctccggggtccctgacaggttcagcggcagtgtgtccggcacagattttacactaaaaatcagcagagtggaggctgacgatattggggtttattactgcatgcaagcaatacaccgcctcactttcggcggaggggaccacactggagatcaacgaactgtggctgcacc

SEQ ID NO: 599019 - DNA, 505 bp, Homo sapiens
  misc_feature: HIJSMM301EEKUU.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcttcggccaagggaccaaggtagaaagtacaaacgaactagtggctgcaccatctgtcttctatcttccccg

SEQ ID NO: 599020 - DNA, 479 bp, Homo sapiens; identical to SEQ ID NO: 535118
  misc_feature: HIJSMM301BKQKQ.13.59.F04.1.454.light.4.raw

SEQ ID NO: 599021 - DNA, 491 bp, Homo sapiens; identical to SEQ ID NO: 535194
  misc_feature: HIJSMM301EXHJN.26.78.H01.1.454.light.4.raw

SEQ ID NO: 599022 - DNA, 519 bp, Homo sapiens
  misc_feature: HIJSMM301APWKO.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggcctgccccctcggtcactctgttcccaccctcctcacg

SEQ ID NO: 599023 - DNA, 503 bp, Homo sapiens; identical to SEQ ID NO: 537216
  misc_feature: HIJSMM301CT8HR.3.70.G04.1.454.light.4.raw

SEQ ID NO: 599024 - DNA, 495 bp, Homo sapiens
  misc_feature: HIJSMM301BFXO5.40.37.D04.1.454.light.4.raw
tctagcgactcacgaccggtgctcgatttagtagcatactgttgggtttgggggatcaggacttctcagttcatcttctcaccatgaggctccctgctcagctcctggggctgctaatgctctggatccctggttccagtgcgagggttgtgatgactcagactccactctctctgtccgtcacccctggacagccggcctccatctcctgcaagtctgctcagagcctcctgcatggtgatggaatcacctatttatattggtacctgcagaagccaggccagtctccacagctcctaatctatgaggtttccagccggttctctggagtgccagataggttcagtggcagcgggtcagtgacagatttcacactgaaaatcagccgggtggaggctgaggatgttggggtttagttactgcatgcaaggtttataccttccttcggactttcggtcccgtcggtaccgacgagtggagtgtcaacgaactagt

SEQ ID NO: 599025 - DNA, 496 bp, Homo sapiens; identical to SEQ ID NO: 535423
  misc_feature: HIJSMM301CC6NH.3.33.C11.1.454.light.4.raw

SEQ ID NO: 599026 - DNA, 520 bp, Homo sapiens
  misc_feature: HIJSMM301A38NC.14.70.G04.1.454.light.4.raw
cgtctagtaccacgaccggtgctcgatttagtgtagtgtgaagggaaaggggagggcagttggtagatgcccctctgggagagatccccagggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagccgtgtgggcaggtcagcccaaggcccaaccccactgtcactctcg

SEQ ID NO: 599027 - DNA, 490 bp, Homo sapiens
  misc_feature: HIJSMM301ASWR1.47.55.E11.1.454.light.4.raw
agctcacgtacacgaccggtgctcgatttagcactcgcacgttgggtttggggagagagacccctcccctgggatcctgcagctccaggctcccgtgggtggggttagagttgggaacctatgaacattctgtaggggccactgtcttctccacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtctaggtcagcccaaggccaaccccactgtcactctgttcccaccctcctctacgtgagct

SEQ ID NO: 599028 - DNA, 520 bp, Homo sapiens; identical to SEQ ID NO: 537173
  misc_feature: HIJSMM301EMXVZ.27.23.C01.1.454.light.4.raw

SEQ ID NO: 599029 - DNA, 490 bp, Homo sapiens; identical to SEQ ID NO: 535526
  misc_feature: HIJSMM301CC5JS.26.78.H01.1.454.light.4.raw

SEQ ID NO: 599030 - DNA, 501 bp, Homo sapiens
  misc_feature: HIJSMM301CTNGG.3.33.C11.1.454.light.4.raw
agacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgatgtcaataatcggccctcaggggtttctaatcgcttctctggctccaagtctggcaacacggcctccctgaccatctctgggctccagggtgaggacgaggctgattattactgcagctcatttacaagcagcaccactcaggtcttcggaactggactaaggtcaccgtctaggtcagcccaaggccaacccactgt

SEQ ID NO: 599031 - DNA, 444 bp, Homo sapiens; identical to SEQ ID NO: 535594
  misc_feature: HIJSMM301BKX2F.9.9.A09.1.454.light.4.raw

SEQ ID NO: 599032 - DNA, 503 bp, Homo sapiens
  misc_feature: HIJSMM301DF1H0.47.55.E11.1.454.light.4.raw
  modified_base (500)..(500): a, c, t, g, unknown or other
agctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctagggcacgtgagactcaggaaatgaccagaggggagtgaatgaggggtgcagagaactccatggctaccaggtcagcccaaggccaaccccactgtcactctgttcccaccctccncta

SEQ ID NO: 599033 - DNA, 493 bp, Homo sapiens
  misc_feature: HIJSMM301A1OFD.16.68.G02.1.454.light.4.raw
  modified_base (487)..(487): a, c, t, g, unknown or other
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcaggtggatctgggacagaattcactctcactatcaccagcctgcaacctgatgattttgcaacttattactgaccaacagtatcatcatcattgtaatttcggtggaggaccaaggtggaggtcaaacgaactgtgctgcacatctgtcttnacttcc

SEQ ID NO: 599034 - DNA, 509 bp, Homo sapiens
  misc_feature: HIJSMM301A6Z60.5.24.C02.1.454.light.4.raw
atcagacacgcacgaccggtgctcgatttagtacagatcgttaggggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcagcccaaggctgtccccccg

SEQ ID NO: 599035 - DNA, 503 bp, Homo sapiens; identical to SEQ ID NO: 538884
  misc_feature: HIJSMM301BITMS.27.78.H01.1.454.light.4.raw

SEQ ID NO: 599036 - DNA, 483 bp, Homo sapiens
  misc_feature: HIJSMM301BCYF9.41.78.H01.1.454.light.4.raw
tctatactatcacgaccggtgctcgatttagtgtgagtagtttgggtttgggggatcaggacttctcagttcatcttctcaccatgaggctccctgctcagctcctggggctgctaatgctctggatacctggatccagtgcagatattgtgatgtcccagactccactctctctgtccgtcacccctggacagccggcctccatctcctgcaagtctagtcagagtctcctccatgagaatggcaaaacttatttctactggtacctacagaaggcaggccagccgccacagctcctgatctatgaggttttcaggcggttctctggagtgccagacaggttcagtggcagcgggtccgggacagatttcacactgaggatcagtcgggtggaggctgacgacgttgggacttattactgcgcgcaaagtctacaccttcctctcactttgggccctgggaccaaaggtgacatcaaacgaa

SEQ ID NO: 599037 - DNA, 489 bp, Homo sapiens; identical to SEQ ID NO: 541702
  misc_feature: HIJSMM301BFESD.10.72.G06.1.454.light.4.raw

SEQ ID NO: 599038 - DNA, 500 bp, Homo sapiens
  misc_feature: HIJSMM301C60IN.49.82.H05.1.454.light.4.raw
agtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaagccagcagtgatgttgggaattataaccttttctcctggtaccaacaacacccaggcaaagcccccaaactcatcatttatgaggccgatcagcggccctcaggggtctctgatcgcttctctggctccacgtctggcagcacggcctccctgacaatctctgggctccaggctggggacgaggctgattattattgctgttcatatgccggtgatagtggccgaagggtgttcggcggagggaccaaggtgaccgttctaggtcagcccaaggctgccccctc

SEQ ID NO: 599039 - DNA, 515 bp, Homo sapiens
  misc_feature: HIJSMM301BXN57.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctcgttcccaccctcct

SEQ ID NO: 599040 - DNA, 469 bp, Homo sapiens
  misc_feature: HIJSMM301DD9SO.18.9.A09.1.454.light.4.raw
tacgagtatgcacgaccggtgctcgatttagcgagacgcgcagggtcctgggcccagtctgtgctgacgcagccgccccagacactgagggcggctgcgtcagcacagactgggcccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggcccaaccctctgtcactctgttcccaccctcctccatactcgta

SEQ ID NO: 599041 - DNA, 508 bp, Homo sapiens; identical to SEQ ID NO: 555268
  misc_feature: HIJSMM301BYFE4.40.12.B01.1.454.light.4.raw

SEQ ID NO: 599042 - DNA, 484 bp, Homo sapiens; identical to SEQ ID NO: 579250
  misc_feature: HIJSMM301A665C.10.1.A01.1.454.light.4.raw

SEQ ID NO: 599043 - DNA, 495 bp, Homo sapiens; identical to SEQ ID NO: 535007
  misc_feature: HIJSMM301B8APF.22.5.A05.1.454.light.4.raw

SEQ ID NO: 599044 - DNA, 481 bp, Homo sapiens
  misc_feature: HIJSMM301C3FZV.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctcccacttcgcctggaccaagtggatatcaaacgaactagtggctgcaccatctgtt

SEQ ID NO: 599045 - DNA, 460 bp, Homo sapiens; identical to SEQ ID NO: 536053
  misc_feature: HIJSMM301BZN84.22.28.C06.1.454.light.4.raw

SEQ ID NO: 599046 - DNA, 518 bp, Homo sapiens
  misc_feature: HIJSMM301DL0N7.15.34.D01.1.454.light.4.raw
  modified_base (448)..(448): a, c, t, g, unknown or other
tctacgtagccacgaccggtgctcgatttagatcgtctgtgttgggtttgggggggaaggcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagacccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtctttatgtgggcgtggcatttgggnggttggccgggtagggaccaaactgaccgtcctaggtcaggcccaaggctgccccctcggtcactcttcg

SEQ ID NO: 599047 - DNA, 416 bp, Homo sapiens
  misc_feature: HIJSMM301CRGGU.49.27.C05.1.454.light.4.raw
agtcgagagacacgaccggtgctcgatttagacgcgatcgaagggtttgggagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctggaaatcagacgaactgtggctgcaccatctgtcttcatcttcccgccatctgatctctcgact

SEQ ID NO: 599048 - DNA, 501 bp, Homo sapiens
  misc_feature: HIJSMM301APUV9.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtacccgtaccaccttttggttccacggggaccgaaacctaggacgatcaaacgaaactagtggctggcaccaactctgtt

SEQ ID NO: 599049 - DNA, 485 bp, Homo sapiens
  misc_feature: HIJSMM301CAXNT.52.24.C02.1.454.light.4.raw
cgcagtacgacacgaccggtgctcgatttagtacagatcgttagggaaaggggagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcgagtcaggacattagcaactatttaaattggtatcagctgaaacccgggaaagcccctaagctcctgatcctcgatgcattcactttggaaacaggggtcccatcaaggttcagtgggagtggctctgggacagattttactttcaccatcagcagcctgcagcctgaggatattgcaacatattactgtcaacagtacgataatctcccgctcactttcggcgggggaccaaggtggagatcaaacgaactgtggctgcaccatctgtctt

SEQ ID NO: 599050 - DNA, 519 bp, Homo sapiens
  misc_feature: HIJSMM301AQC7Y.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgcccccctggtccactctgttcccaccctctccacg

SEQ ID NO: 599051 - DNA, 444 bp, Homo sapiens; identical to SEQ ID NO: 537971
  misc_feature: HIJSMM301BP5TZ.2.76.G10.1.454.light.4.raw

SEQ ID NO: 599052 - DNA, 479 bp, Homo sapiens
  misc_feature: HIJSMM301DRE0T.48.68.G02.1.454.light.4.raw
agtatacatacacgaccggtgctcgatttagtcgatagtgaagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttatcactatgtctcctggtaccaacagcaccctggcaaagcccccaaactcatgatttatgatatcactaagcggccctcaggggtccctgatcgcttctctggctcccagtctggcaacacggcctccctgaccatctctgggctccaggctgaggatgaggctgattattactgctgctcatatgcaggcagctacactttggtgttcggcggagggaccaagctgactgttcc

SEQ ID NO: 599053 - DNA, 416 bp, Homo sapiens; identical to SEQ ID NO: 545902
  misc_feature: HIJSMM301DU2MJ.18.78.H01.1.454.light.4.raw

SEQ ID NO: 599054 - DNA, 507 bp, Homo sapiens
  misc_feature: HIJSMM301CQ762.8.42.D09.1.454.light.4.raw
ctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctcggtcactctgttcccacct

SEQ ID NO: 599055 - DNA, 487 bp, Homo sapiens
  misc_feature: HIJSMM301AKED0.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccgaggtcaccgtcctaggtcagcccaaggccaacccca

SEQ ID NO: 599056 - DNA, 492 bp, Homo sapiens
  misc_feature: HIJSMM301DESZF.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgtttacttttggccaggggaccaaactggatatcagacgaactgtggctgcacc

SEQ ID NO: 599057 - DNA, 441 bp, Homo sapiens; identical to SEQ ID NO: 534971
  misc_feature: HIJSMM301BM0HL.11.3.A03.1.454.light.4.raw

SEQ ID NO: 599058 - DNA, 518 bp, Homo sapiens
  misc_feature: HIJSMM301C6PCI.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcggtccaacggacgaacggtggaaggtacaaacgaactacgtggcgtgcgaccactctgtcttctactcttcccgtccctact

SEQ ID NO: 599059 - DNA, 465 bp, Homo sapiens
  misc_feature: HIJSMM301A9TJQ.13.4.A04.1.454.light.4.raw
tcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagattttactttcaccatcagcagcctgcagcctgaagatattgcaacatattactgtcagcagtatgataatctcccgatcaccttcggccaagggacacgactggagattaacgaa

SEQ ID NO: 599060 - DNA, 504 bp, Homo sapiens; identical to SEQ ID NO: 562438
  misc_feature: HIJSMM301ECOY9.19.85.H08.1.454.light.4.raw

SEQ ID NO: 599061 - DNA, 510 bp, Homo sapiens; identical to SEQ ID NO: 537801
  misc_feature: HIJSMM301EEETJ.5.60.F05.1.454.light.4.raw

SEQ ID NO: 599062 - DNA, 497 bp, Homo sapiens; identical to SEQ ID NO: 535664
  misc_feature: HIJSMM301ENNO1.22.14.B03.1.454.light.4.raw

SEQ ID NO: 599063 - DNA, 454 bp, Homo sapiens; identical to SEQ ID NO: 534964
  misc_feature: HIJSMM301AOTG6.19.86.H09.1.454.light.4.raw

SEQ ID NO: 599064 - DNA, 495 bp, Homo sapiens
  misc_feature: HIJSMM301BC1D1.47.36.D03.1.454.light.4.raw
agctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaagcccctaacctcctcatctctactgcatccactttgcaaagtggggtcccatcaaggttcagcggcagtggatctgggacagatttcactctcactatcagcagcctgcagcctgaagtattttggaactttattattgtacaacagggtaacacgtttcccgctccaccttcggcggagggaccaaggtggagatagaaaagaactgtggctgcaccat

SEQ ID NO: 599065 - DNA, 476 bp, Homo sapiens
  misc_feature: HIJSMM301BC1VO.51.34.D01.1.454.light.4.raw
cgatcgtatacacgaccggtgctcgatttagatcgtctgtgttgggtttgggggcagaagtctctctcagtcaggacacagcatggacatgagggtccctgctcagctcctgggactcctgctgctctggctcccagataccagatgtgacatccagatgacccagtctccatcctccctgtctgcatctataggagacagagtcaccatcacttgccgggcgagtcagggcgtcagcatttatttggcctggtatcagcagagaccagggaaagctcctaaactcctgatctatgaggcatccactttacaatcaggggtcccatctcgtttcagtggcagtggatctggggcacatttcactctcaccatcagcagcctgcagcctgacgatgttgcaacttattactgtcaaaattataacagggccgttgcgctcactttcggcggggggaccgaaggtggagatcaagacg

SEQ ID NO: 599066 - DNA, 514 bp, Homo sapiens; identical to SEQ ID NO: 547648
  misc_feature: HIJSMM301BLOGD.16.1.A01.1.454.light.4.raw

SEQ ID NO: 599067 - DNA, 491 bp, Homo sapiens
  misc_feature: HIJSMM301D5MMO.51.39.D06.1.454.light.4.raw
cgatcgtatacacgaccggtgctcgatttagtgacatctcgcagttctttgggggtgggtccaggaggcagaactctgggtgtctcaccatggcctggatccctctacttctccccctcctcactctctgcacaggctctgacggcctcctatgtgctgacacagccaccctcggtgtccgtgtccccaggacagacggccaggatcacctgctctggagatgcattgccaacccactattcttattggtaccaacagaagccaggccaggcccctgtgttgttgatatataaagacagtgagaggccttcagggatccctgagcgattctctggctccacctcagggacactggtcacattgaccatcagtggagtccaggcagaagacgaggctgactatttctgtcaatcttcagacgtcagtgatacttatgttcgtacgacgtcggacgagtccaccgtcgtagtcgacgaccgacgacccaaccc

SEQ ID NO: 599068 - DNA, 507 bp, Homo sapiens
  misc_feature: HIJSMM301EDY8H.47.85.H08.1.454.light.4.raw
agctcacgtacacgaccggtgctcgatttagtatcactcagtcgcgggggctgggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgccctcaggggtttctcatcgcttctctggctccaaatctggcaacacggcctccctgaccatctctgggctcgagtctgaggacgaggctgattacttctgttgctcttgggcaactactgtcgttttgggtgtttcggcggagggaccaagttgaccgtcctaggtcagcccaaggctgccccctggtcactt

SEQ ID NO: 599069 - DNA, 491 bp, Homo sapiens
  misc_feature: HIJSMM301ERGQO.19.71.G05.1.454.light.4.raw
  modified_base (484)..(484): a, c, t, g, unknown or other
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggtccaagggaccgaaggtagggataatnagacgaa

SEQ ID NO: 599070 - DNA, 384 bp, Homo sapiens; identical to SEQ ID NO: 540224
  misc_feature: HIJSMM301A75PW.48.53.E09.1.454.light.4.raw

SEQ ID NO: 599071 - DNA, 486 bp, Homo sapiens; identical to SEQ ID NO: 535917
  misc_feature: HIJSMM301ASXI3.3.10.A10.1.454.light.4.raw

SEQ ID NO: 599072 - DNA, 487 bp, Homo sapiens
  misc_feature: HIJSMM301CM6LN.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctccggtcactctgttcccaccctcctccgctacgtaga

SEQ ID NO: 599073 - DNA, 503 bp, Homo sapiens
  misc_feature: HIJSMM301DZHI5.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctggtcactctgttcccaccctcctcg

SEQ ID NO: 599074 - DNA, 522 bp, Homo sapiens
  misc_feature: HIJSMM301C2K2Q.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgctttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccgccct

SEQ ID NO: 599075 - DNA, 489 bp, Homo sapiens
  misc_feature: HIJSMM301C3SRV.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattaactgccaacaataatgatatttaattctccagcgttcggcagggaccaaggtggaagtcaagcgaactgtgctgcaccatctgtt

SEQ ID NO: 599076 - DNA, 501 bp, Homo sapiens; identical to SEQ ID NO: 579640
  misc_feature: HIJSMM301AD0VI.9.81.H04.1.454.light.4.raw

SEQ ID NO: 599077 - DNA, 486 bp, Homo sapiens; identical to SEQ ID NO: 583597
  misc_feature: HIJSMM301ENGMP.46.35.D02.1.454.light.4.raw

SEQ ID NO: 599078 - DNA, 500 bp, Homo sapiens; identical to SEQ ID NO: 539795
  misc_feature: HIJSMM301DALEB.22.38.D05.1.454.light.4.raw

SEQ ID NO: 599079 - DNA, 490 bp, Homo sapiens; identical to SEQ ID NO: 547085
  misc_feature: HIJSMM301AHUV0.12.51.E07.1.454.light.4.raw

SEQ ID NO: 599080 - DNA, 488 bp, Homo sapiens; identical to SEQ ID NO: 580132
  misc_feature: HIJSMM301AIM5G.19.71.G05.1.454.light.4.raw

SEQ ID NO: 599081 - DNA, 494 bp, Homo sapiens; identical to SEQ ID NO: 535828
  misc_feature: HIJSMM301BFKUB.3.36.D03.1.454.light.4.raw

SEQ ID NO: 599082 - DNA, 502 bp, Homo sapiens; identical to SEQ ID NO: 536253
  misc_feature: HIJSMM301AUNU9.21.22.B11.1.454.light.4.raw

SEQ ID NO: 599083 - DNA, 516 bp, Homo sapiens
  misc_feature: HIJSMM301CCSGC.22.36.D03.1.454.light.4.raw
acatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaacccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaattaggcgccactctcgtggttttcggcggaggcaccgaagtgaccgtctcggtcagcccaaggctgccccctcggtccactctcg

SEQ ID NO: 599084 - DNA, 504 bp, Homo sapiens
  misc_feature: HIJSMM301DQVO0.40.67.G01.1.454.light.4.raw
tctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtgggtctgggacagccttcactctcaccatcagcagcctggagcccgaagattttgcggtttattactgtcagcagcgtgccgactggcccctcacgttcggcggagggaccaaggtggacatcaaacgaactgtggctgcaccatctgtcttcatcttccgcc

SEQ ID NO: 599085 - DNA, 480 bp, Homo sapiens
  misc_feature: HIJSMM301CSDLX.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccggctcattttcggcggagggaccaaggtgcagatcaaacgaactgtgg

SEQ ID NO: 599086 - DNA, 383 bp, Homo sapiens
  misc_feature: HIJSMM301EJF39.48.27.C05.1.454.light.4.raw
agtatacatacacgaccggtgctcgatttagacgcgatcgaagggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcacca

SEQ ID NO: 599087 - DNA, 498 bp, Homo sapiens; identical to SEQ ID NO: 536879
  misc_feature: HIJSMM301CS88L.22.14.B03.1.454.light.4.raw

SEQ ID NO: 599088 - DNA, 509 bp, Homo sapiens
  misc_feature: HIJSMM301C2IPH.10.60.F05.1.454.light.4.raw
catagtagtgcacgaccggtgctcgatttagtacgtcatcagggaaaggggggggtctcaggaggcagcactctcgggacgtctccaccatggcctgggctctgctcctcctcagcctcctcactcagggcacaggatcttgggctcagtctgccctgactcagcctcgctcagtgtccgggtctcctggacagtcagttaccatctcctgcactggaacctccaatgatgttggtggttatatctatgtctcctggtaccaacaacacgcaggcaaagcccccgaagtcatgatttatgatgtcagtaagcggccctcaggggtccctgaccgcttctctggctccaagtctggcaacacggcctccctgaccatctctggcctccaggctgaggatgaggctgactattattgctgctcatatgcgaggccgtacgttcggttccggtatcgttcgtacgtacggtcggaccgtacggtccaccgtccgtaggtcacgacccgacga

SEQ ID NO: 599089 - DNA, 486 bp, Homo sapiens; identical to SEQ ID NO: 536329
  misc_feature: HIJSMM301AURXT.21.4.A04.1.454.light.4.raw

SEQ ID NO: 599090 - DNA, 497 bp, Homo sapiens; identical to SEQ ID NO: 578089
  misc_feature: HIJSMM301EJO0U.40.57.F02.1.454.light.4.raw

SEQ ID NO: 599091 - DNA, 486 bp, Homo sapiens
  misc_feature: HIJSMM301EKJ97.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagtctgcaggctgaagatgtggcagtttattactgtcagcaatattatagtactcctccgaggctcactttcggcggagggaccaagggtggagatcaaacgaa

SEQ ID NO: 599092 - DNA, 490 bp, Homo sapiens; identical to SEQ ID NO: 543909
  misc_feature: HIJSMM301BMSA0.14.55.E11.1.454.light.4.raw

SEQ ID NO: 599093 - DNA, 520 bp, Homo sapiens; identical to SEQ ID NO: 553566
  misc_feature: HIJSMM301EPWT5.27.23.C01.1.454.light.4.raw

SEQ ID NO: 599094 - DNA, 486 bp, Homo sapiens
  misc_feature: HIJSMM301ARBSJ.53.5.A05.1.454.light.4.raw
cgcgtatacacacgaccggtgctcgatttagatagatagacagggggggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatggattgccaaagcactatggttactggtaccaacagaagccaggccaggcccctctattggtaatgtataaagacaatgagaggccctcagggatccctgagcgattctctggctccaactcagggacaacagtcacgttgaccatcggtggagtccaggcagaagacgaggctgactattactgtcaatcagcaggcagcagtggaactgtgctttcggcggagggaccaagctgaccgtcctacgtcagccc

SEQ ID NO: 599095 - DNA, 487 bp, Homo sapiens; identical to SEQ ID NO: 544897
  misc_feature: HIJSMM301A3LE9.46.35.D02.1.454.light.4.raw

SEQ ID NO: 599096 - DNA, 507 bp, Homo sapiens
  misc_feature: HIJSMM301EYMJ1.48.34.D01.1.454.light.4.raw
agtatacatacacgaccggtgctcgatttagatcgtctgtgttgggtttgggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactgggcccaggtggaggatgaaggtgactacttctgtttctcaacagacaccagtgacaatcatgcgattttcggcggagggaccaagctgaccgtcctgggtcagcccaaggctcgccccctcggtcactctgtt

SEQ ID NO: 599097 - DNA, 500 bp, Homo sapiens
  misc_feature: HIJSMM301AY7QZ.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggtccaggggaccgaagctggaggatcaaacgaactagtggcgtgcaccatctgtctt

SEQ ID NO: 599098 - DNA, 494 bp, Homo sapiens
  misc_feature: HIJSMM301BYBHC.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcagggtggaggctgaggatgttggggtttgttcctccatgcaaggtacacactggcccttttggccaggggaccaacctggagatcaaatgaactgtggctgcaccatctgtctt

SEQ ID NO: 599099 - DNA, 491 bp, Homo sapiens
  misc_feature: HIJSMM301BE6XC.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcggtcggagggaccgaaggcggagatcagacgaactgtggctgcaccaatctgtcttcta

SEQ ID NO: 599100 - DNA, 485 bp, Homo sapiens; identical to SEQ ID NO: 538840
  misc_feature: HIJSMM301DCCOS.19.71.G05.1.454.light.4.raw

SEQ ID NO: 599101 - DNA, 490 bp, Homo sapiens; identical to SEQ ID NO: 542534
  misc_feature: HIJSMM301BDAAT.16.68.G02.1.454.light.4.raw

SEQ ID NO: 599102 - DNA, 485 bp, Homo sapiens; identical to SEQ ID NO: 573100
  misc_feature: HIJSMM301E08FY.49.35.D02.1.454.light.4.raw

SEQ ID NO: 599103 - DNA, 513 bp, Homo sapiens; identical to SEQ ID NO: 535719
  misc_feature: HIJSMM301DF27S.17.33.C11.1.454.light.4.raw

SEQ ID NO: 599104 - DNA, 487 bp, Homo sapiens
  misc_feature: HIJSMM301AKS08.49.64.F09.1.454.light.4.raw
agtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccgggaaggcccctaagttactgatctatgctgcagccaatttgcaaagtggggtcccatcaaggttcagtggcagtggatctgggacagaattcactctcaccatcagcagtctgcaacctgaagatttggaaagtactattgtcaacagagttacggaaacttgctcattttcggcggagggaccaaaggtggagatcaaaagaactagtggctgcaccatctgtcttcta

SEQ ID NO: 599105 - DNA, 483 bp, Homo sapiens; identical to SEQ ID NO: 550383
  misc_feature: HIJSMM301C3XUR.48.81.H04.1.454.light.4.raw

SEQ ID NO: 599106 - DNA, 503 bp, Homo sapiens; identical to SEQ ID NO: 550542
  misc_feature: HIJSMM301D2HEI.2.76.G10.1.454.light.4.raw

SEQ ID NO: 599107 - DNA, 491 bp, Homo sapiens
  misc_feature: HIJSMM301AJLW0.51.30.C08.1.454.light.4.raw
cgatcgtatacacgaccggtgctcgatttagtctgacgtcaaagggaaagggcagctcctggggctgctaatgctctgggtcccaggatgcactggggatgttgtggtgactcagtctcctctctccctgcccgtcacccttggacaggcggcctccatctcctgcaggtctagtcacagcctcctacacagtgatggaaacacctacttgacttggtttcagcagaggcctggccaatctccaaggcgccttatttataaggtttctaatcgggactttggggtcccagacagattcagcggcagtgggtcacgcactcacttcacactgaaaatcagcagggtggaggctgaggatttaggggtttattactgcatgcaaggtacacactggcctccgtacacttttggccaggggaccaaggctcgagatcaaacgaactgtggctgcaccatctgtcttcatcttcccgccatctgatcgtagcact

SEQ ID NO: 599108 - DNA, 507 bp, Homo sapiens
  misc_feature: HIJSMM301B2OPF.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccaaggtggagatcaaacgactgtggctgcaccatctgtcttcta

SEQ ID NO: 599109 - DNA, 506 bp, Homo sapiens; identical to SEQ ID NO: 538849
  misc_feature: HIJSMM301C7626.43.15.B04.1.454.light.4.raw

SEQ ID NO: 599110 - DNA, 487 bp, Homo sapiens; identical to SEQ ID NO: 544897
  misc_feature: HIJSMM301AOQU8.46.35.D02.1.454.light.4.raw

SEQ ID NO: 599111 - DNA, 510 bp, Homo sapiens; identical to SEQ ID NO: 535855
  misc_feature: HIJSMM301CACV9.17.33.C11.1.454.light.4.raw

SEQ ID NO: 599112 - DNA, 474 bp, Homo sapiens
  misc_feature: HIJSMM301EOU6B.5.34.D01.1.454.light.4.raw
atcagacacgcacgaccggtgctcgatttagatcgtctgtgttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccctccgaccttcggccaagggacacgactcggagattaaacgaa

SEQ ID NO: 599113 - DNA, 490 bp, Homo sapiens
  misc_feature: HIJSMM301DOTPA.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtcgccccccgatccaccttcggccaagggacacgactggagattaaacgaactgtgctgcaccatctgtcttcat

SEQ ID NO: 599114 - DNA, 496 bp, Homo sapiens; identical to SEQ ID NO: 570072
  misc_feature: HIJSMM301CMB3Y.12.23.C01.1.454.light.4.raw

SEQ ID NO: 599115 - DNA, 505 bp, Homo sapiens
  misc_feature: HIJSMM301AK1BU.48.33.C11.1.454.light.4.raw
agtatacatacacgaccggtgctcgatttagagtgagctcgttgggtttgggggagctacaacaggcaggcaggggcagcaagatggtgttgcagacccaggtcttcatttctctgttgctctggatctctggtgcctacggggacgtcgtgatgacccagtctccagactccctggcagtgtctctgggcgggagggccaccatcaactgcaagtccagccagagtattttatacagctcctacaataagagcgacttagcttggtaccagcagaaaccaggacagcctcctaagttgctcatttactgggcatctaaccggcaatccggggtccctgaccgattcagtggcagcgggtctgggacacatttcgctttcaccatcagcagcctgcaggctgaggatgtggcagtttattactgtcagcaaatattatactactccgtggactttcggccaagggaccgaaggtaggaaagtacagacgaactgtggctgcacca

SEQ ID NO: 599116 - DNA, 510 bp, Homo sapiens
  misc_feature: HIJSMM301DCRBP.7.34.D01.1.454.light.4.raw
cgtgtctctacacgaccggtgctcgatttagatcgtctgtgttgggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacagcattatttgggtgttcggcggagggaccaagctgaccgtcctgcgtcagccaaggctgccccctcggtcact

SEQ ID NO: 599117 - DNA, 535 bp, Homo sapiens
  misc_feature: HIJSMM301BXC28.43.45.E01.1.454.light.4.raw
tgtgagtagtcacgaccggtgctcgatttagtgagtcagtaagggaaaggggctgggcctgaggaagcagcactggtggtgcctcagccatggcctggaccgttctcctcctcggcctcctctctcactgcacaggctccgtgacctcctatgaactgactcagcccccctcggtgtctgtggccccaggacagacggccagcattacctgtgggggatacaactttgcccagaaaaatgtacattggtatcagcagaaggcaggccaggcccctgtgatggtcgtctgtgacgatagggaccggccctcggggatccttgagcgattctctggctccaagtctgggaacacggccactctgaccatcagccgggtcgaggccggggacgaggccgactattattgtcaactgtgggatggtactggtgaccggtactggggtgttcgggcggaggggaccaagctgaccgtcctaggtcagcccaaggcctgcccccctcggtccactctgttcccgccctccctcactactca

SEQ ID NO: 599118 - DNA, 510 bp, Homo sapiens
  misc_feature: HIJSMM301CXTZB.16.46.E02.1.454.light.4.raw
tgtactactccacgaccggtgctcgatttagactcatctacagggaaagggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacatacttttgtcttcggaactgggaccaaggtcaccgtcctaggtcagcccaaggccaacccactgtcactcttcg

SEQ ID NO: 599119 - DNA, 460 bp, Homo sapiens; identical to SEQ ID NO: 536053
  misc_feature: HIJSMM301CWEXE.22.28.C06.1.454.light.4.raw

SEQ ID NO: 599120 - DNA, 479 bp, Homo sapiens; identical to SEQ ID NO: 547479
  misc_feature: HIJSMM301BJG07.16.81.H04.1.454.light.4.raw

SEQ ID NO: 599121 - DNA, 499 bp, Homo sapiens; identical to SEQ ID NO: 562784
  misc_feature: HIJSMM301CB52M.40.23.C01.1.454.light.4.raw

SEQ ID NO: 599122 - DNA, 508 bp, Homo sapiens
  misc_feature: HIJSMM301BSOR9.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattacttgcatgcaaactacacacggccgctcactttcggcggagggaccgaaggtggagatcaaacgaactgtggctgcaccatctgtt

SEQ ID NO: 599123 - DNA, 504 bp, Homo sapiens; identical to SEQ ID NO: 538940
  misc_feature: HIJSMM301ARVY0.2.35.D02.1.454.light.4.raw

SEQ ID NO: 599124 - DNA, 488 bp, Homo sapiens
  misc_feature: HIJSMM301A0DZ3.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgtaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgaactgt

SEQ ID NO: 599125 - DNA, 510 bp, Homo sapiens; identical to SEQ ID NO: 537801
  misc_feature: HIJSMM301CWX31.5.60.F05.1.454.light.4.raw

SEQ ID NO: 599126 - DNA, 447 bp, Homo sapiens; identical to SEQ ID NO: 535201
  misc_feature: HIJSMM301DEXNH.18.9.A09.1.454.light.4.raw

SEQ ID NO: 599127 - DNA, 482 bp, Homo sapiens
  misc_feature: HIJSMM301BO8PI.49.86.H09.1.454.light.4.raw
agtcgagagacacgaccggtgctcgatttagtgctatagacttgggtttgggggaatcagtcccactcaggacacagcatggacatgagggtccccgctcagctcctggggctcctgctgctctggttcccaggtgccaggtgtggcatccaggtgacccagtctccatcctccctgtctgcatctgtaggagacagagtcaccatcacctgccgggcaagtcaggacattagaaacgatttaggctggtatcagcagaaagcagggcaagcccctaagcgcctgatctatggtgcagccagtttgcacggtggggtcccatcaagattcagcggcagtggatctgggacagaattcactctcacaatcagcagcctgcagcctgaagattttgcaacttattactgtctacagcataatagtaacccttggacgttcggccaagggaccagggtggaaatcaaacgaactgtggctgcacc

SEQ ID NO: 599128 - DNA, 487 bp, Homo sapiens
  misc_feature: HIJSMM301B8LFO.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaaccttttggccaggggaccaagctggagatcaaacgaactgtggctgcaccat

SEQ ID NO: 599129 - DNA, 504 bp, Homo sapiens; identical to SEQ ID NO: 572542
  misc_feature: HIJSMM301EG7W2.27.78.H01.1.454.light.4.raw

SEQ ID NO: 599130 - DNA, 491 bp, Homo sapiens
  misc_feature: HIJSMM301DUUPE.49.67.G01.1.454.light.4.raw
agtcgagagacacgaccggtgctcgatttagagtatacatattgggtttgggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgagattttgcagtctattactgtcagcagcgttacaactggcctcccatgtacacttttggccaggggaccaagctggaaatcagacgaactgtggctgcaccat

SEQ ID NO: 599131 - DNA, 487 bp, Homo sapiens; identical to SEQ ID NO: 537573
  misc_feature: HIJSMM301AQZC6.3.10.A10.1.454.light.4.raw

SEQ ID NO: 599132 - DNA, 507 bp, Homo sapiens; identical to SEQ ID NO: 544788
  misc_feature: HIJSMM301CQ61P.16.46.E02.1.454.light.4.raw

SEQ ID NO: 599133 - DNA, 527 bp, Homo sapiens
  misc_feature: HIJSMM301BA2R0.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaactagttttctcggggcgttcggccgtaacgggaaccgaaggtaggaaagtacgaaaacgaaacgtacgtaggcgtggccaccactctcgtcttctactcttcccccg

SEQ ID NO: 599134 - DNA, 457 bp, Homo sapiens
  misc_feature: HIJSMM301A1LO6.15.11.A11.1.454.light.4.raw
tctacgtagccacgaccggtgctcgatttagctacgactgcagggtgggtaagaaatacctgcaactgtcagcctcagcagagctctggggagtctgcaccatggcttggaccccactcctcttcctcaccctcctcctccactgcacagggtctctctcccagcttgtgctgactcaatcgccctctgcctctgcctccctgggagcctcggtcaagctcacctgcactctgagcagtgggcacaccagctacgccatcgcatggcatcagcagcagccagagaagggccctcgctacttgatgaagcttaacactgatggcagccacagtaagggggacgggatccctgatcgcttctcaggctccagctctggggctgagcgctacctcaccatctccagcctccagtctgaggatgaggctgactattactgtcagaccgtggggcacgtggc

SEQ ID NO: 599135 - DNA, 512 bp, Homo sapiens
  misc_feature: HIJSMM301D68ID.48.35.D02.1.454.light.4.raw
agtatacatacacgaccggtgctcgatttagcacacgatagttgggtttgggggtgggctcaggaggcagagctctgggaatctcaccatggcctggacccctctcctgcctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgtcccgccct

SEQ ID NO: 599136 - DNA, 489 bp, Homo sapiens; identical to SEQ ID NO: 535139
  misc_feature: HIJSMM301AL7MA.14.55.E11.1.454.light.4.raw

SEQ ID NO: 599137 - DNA, 523 bp, Homo sapiens
  misc_feature: HIJSMM301A3G1A.11.57.F02.1.454.light.4.raw
  modified_base (482)..(482): a, c, t, g, unknown or other
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaaccgtgcgngcgccacatcgtcgttcttactcttccctcccgactactcg

SEQ ID NO: 599138 - DNA, 489 bp, Homo sapiens; identical to SEQ ID NO: 535139
  misc_feature: HIJSMM301CL6D0.14.55.E11.1.454.light.4.raw

SEQ ID NO: 599139 - DNA, 490 bp, Homo sapiens; identical to SEQ ID NO: 535420
  misc_feature: HIJSMM301AYT32.3.72.G06.1.454.light.4.raw

SEQ ID NO: 599140 - DNA, 509 bp, Homo sapiens; identical to SEQ ID NO: 542468
  misc_feature: HIJSMM301EYNJG.8.33.C11.1.454.light.4.raw

SEQ ID NO: 599141 - DNA, 474 bp, Homo sapiens
  misc_feature: HIJSMM301B7YLF.12.39.D06.1.454.light.4.raw
atacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggaggggaatggggtgagaaagatccagtgtagagattgtgatgacccagactccagtctccttgtctctcacccctggagagcaggcctccatgtcctgcaggtctagtctgcgcctcctgcatagtgacggatgctccctttttgtattggtttctgcagagaggcaggccagtctccacaactcctgatctatgaagttgccacccggctctctggagtgccagatatgttcagtggctgcgggtcaggcacagatctcacactagaaaacagccgggtggagagtgaccatgttggaacttattactgcatgc

SEQ ID NO: 599142 - DNA, 518 bp, Homo sapiens
  misc_feature: HIJSMM301E3B03.9.12.B01.1.454.light.4.raw
  modified_base (430)..(430): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttcncgggcgttcggtccgaacgggaccgaacggtaggaaatacgaaaacgaaactagtaggctggcaccactctgtcttctatcttccccg

SEQ ID NO: 599143 - DNA, 479 bp, Homo sapiens; identical to SEQ ID NO: 535118
  misc_feature: HIJSMM301AMVTV.13.59.F04.1.454.light.4.raw

SEQ ID NO: 599144 - DNA, 511 bp, Homo sapiens
  misc_feature: HIJSMM301DPJQB.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcaggtgggtctgggacagacttcactctcaccatcagcagactggagcctggaggtattttgcagtgtattactgtcagcagtatcataggtcaaactaccttcggccgaagggacacgactaggagtaagttaaaggaactggtggcgtgccacactctgttcttctacttccttccccg

SEQ ID NO: 599145 - DNA, 509 bp, Homo sapiens
  misc_feature: HIJSMM301BFBRN.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtcggccgtccgggggccactttcggccctgggaccaaaggtggatatacaaacgaactgtggctgcaccatctgtctt

SEQ ID NO: 599146 - DNA, 483 bp, Homo sapiens
  misc_feature: HIJSMM301DBEB7.17.26.C04.1.454.light.4.raw
cgtagactagcacgaccggtgctcgatttagtctagcgactttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcacttttcggcggagggaccaaggtggagatcaaacgaactgtggctgcaccat

SEQ ID NO: 599147 - DNA, 490 bp, Homo sapiens; identical to SEQ ID NO: 538273
  misc_feature: HIJSMM301C9PAB.16.73.G07.1.454.light.4.raw

SEQ ID NO: 599148 - DNA, 476 bp, Homo sapiens; identical to SEQ ID NO: 538611
  misc_feature: HIJSMM301DD5VP.7.81.H04.1.454.light.4.raw

SEQ ID NO: 599149 - DNA, 454 bp, Homo sapiens; identical to SEQ ID NO: 535005
  misc_feature: HIJSMM301AKTX5.19.86.H09.1.454.light.4.raw

SEQ ID NO: 599150 - DNA, 490 bp, Homo sapiens; identical to SEQ ID NO: 570048
  misc_feature: HIJSMM301BJL8H.47.55.E11.1.454.light.4.raw

SEQ ID NO: 599151 - DNA, 499 bp, Homo sapiens
  misc_feature: HIJSMM301BL52X.4.27.C05.1.454.light.4.raw
agcactgtagcacgaccggtgctcgatttagacgcgatcgaaggggtttgggggctgggcctcaggaagcagcatcggaggtgcctcagccatggcatggatccctctcttcctcggcgtccttgcttactgcacaggatgcgtgacctcttatgagctgactcagccacctcactgtccgtgtccccaggacagacagccaccattacctgctctggaaatgaattggcagataagtttgtgtgttggtatcaagtgaggccaggccagtcccctctttagtcatgtatcgggatagaaagcggccctcagggatccctgagcgcttctctggatccaactctgggaacacagccactctgaccatcagcgggacccaacttttagatgaggccgactattctgtctacacgtgggacatgggcactgcgatcttcggcggagggaccaagctggaccgtcctgggtcagcccaaggctgccccctcggtacactccg

SEQ ID NO: 599152 - DNA, 447 bp, Homo sapiens; identical to SEQ ID NO: 535020
  misc_feature: HIJSMM301DQ9EO.18.9.A09.1.454.light.4.raw

SEQ ID NO: 599153 - DNA, 505 bp, Homo sapiens; identical to SEQ ID NO: 536117
  misc_feature: HIJSMM301EBQCK.8.71.G05.1.454.light.4.raw

SEQ ID NO: 599154 - DNA, 506 bp, Homo sapiens; identical to SEQ ID NO: 534969
  misc_feature: HIJSMM301ATYDR.18.37.D04.1.454.light.4.raw

SEQ ID NO: 599155 - DNA, 500 bp, Homo sapiens; identical to SEQ ID NO: 540012
  misc_feature: HIJSMM301C6LVW.52.34.D01.1.454.light.4.raw

SEQ ID NO: 599156 - DNA, 508 bp, Homo sapiens; identical to SEQ ID NO: 560800
  misc_feature: HIJSMM301B4YZY.17.33.C11.1.454.light.4.raw

SEQ ID NO: 599157 - DNA, 487 bp, Homo sapiens; identical to SEQ ID NO: 537208
  misc_feature: HIJSMM301DU2JJ.3.55.E11.1.454.light.4.raw

SEQ ID NO: 599158 - DNA, 499 bp, Homo sapiens; identical to SEQ ID NO: 535899
  misc_feature: HIJSMM301BTCKK.19.78.H01.1.454.light.4.raw

SEQ ID NO: 599159 - DNA, 501 bp, Homo sapiens
  misc_feature: HIJSMM301AP44Z.22.38.D05.1.454.light.4.raw
acatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagaatgttagtagttacttagcctggtaccagcaaaagcctggccaggctcccagactcctcatctctgatacatccaacagggccactggcatcccagccaggttcagtggcagtgggtctgggacagacttcactctcaccatcagcgacctagagcctgaagattttgctagtttattactgtcagcagcgtagcatctggcctccgtacacctttggccaggggaccaagctggagatcaaacgaactgtggctgcaccatctgtcttcatt

SEQ ID NO: 599160 - DNA, 490 bp, Homo sapiens; identical to SEQ ID NO: 535420
  misc_feature: HIJSMM301DNO39.3.72.G06.1.454.light.4.raw

SEQ ID NO: 599161 - DNA, 515 bp, Homo sapiens
  misc_feature: HIJSMM301CII07.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggtcgggggaccggaacggtaggaggttcgtaaacgaaacctagtggccgtgcacccaactcttcgtccttctactt

SEQ ID NO: 599162 - DNA, 492 bp, Homo sapiens; identical to SEQ ID NO: 573597
  misc_feature: HIJSMM301EDURP.10.72.G06.1.454.light.4.raw

SEQ ID NO: 599163 - DNA, 501 bp, Homo sapiens
  misc_feature: HIJSMM301CO3W5.15.83.H06.1.454.light.4.raw
tctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgcaaagtggggccccatcaaggttcagtggcagtggctctgggacagatttcactctcaccatcagcagtctccaacctgaagattttgcaacttactactgtcaacagagtttcagtagtccccggacgttcgtccaaggaccgaacggtaggacgaatacaaacgaaaccagtaggcgtgcaccatactgtctt

SEQ ID NO: 599164 - DNA, 454 bp, Homo sapiens; identical to SEQ ID NO: 535005
  misc_feature: HIJSMM301BL3MN.19.86.H09.1.454.light.4.raw

SEQ ID NO: 599165 - DNA, 447 bp, Homo sapiens; identical to SEQ ID NO: 535201
  misc_feature: HIJSMM301AL638.18.9.A09.1.454.light.4.raw

SEQ ID NO: 599166 - DNA, 499 bp, Homo sapiens
  misc_feature: HIJSMM301BPYU0.10.79.H02.1.454.light.4.raw
catagtagtgcacgaccggtgctcgatttagtgtcacacgaagggaaaggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggcctcccgggctcctcatctatggtacatctagcagggccactggcatcccagacaggttcagtggcagtgggtctgggacagacttcactctcaccatcagcagactggagtctgaagtattttgcagtgtattattgtcagcaatatggtaggtcacctgggtacttttggccgacggggaccaagctggagatacaaacgaactgtggctgcacatctgtctt

SEQ ID NO: 599167 - DNA, 485 bp, Homo sapiens; identical to SEQ ID NO: 538956
  misc_feature: HIJSMM301DIR5E.40.69.G03.1.454.light.4.raw

SEQ ID NO: 599168 - DNA, 471 bp, Homo sapiens
  misc_feature: HIJSMM301C0EWJ.3.38.D05.1.454.light.4.raw
agacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactacccctctcactttcggcgggggaccaaggtggagatcaacgaa

SEQ ID NO: 599169 - DNA, 454 bp, Homo sapiens
  misc_feature: HIJSMM301E08MK.51.45.E01.1.454.light.4.raw
cgatcgtatacacgaccggtgctcgatttagtgagtcagtaagggaaaggggtgatcaggactcctcagttcaccttctcacaatgaggctccctgctcagctcctggggctgctaatgctctgggtctctggatccagtggggatattgtcatgactcagtctccactctccctgcccgtcacccctggagagccggcctccatctcctgcaggtctagtcagagcctcctccataatagtggattcttctatttggattggttcagtggcagtggatcaggcacagattttacactgacaaatcaacagagtggaggctgaggatgttggggtttattactgcgtgcaaagtctgcaaactatcaccttcggccaagggacacgactggagattaaaacgaactgtggctgcaccatctgtcttcatcttcccgccatctgatcgtagcact

SEQ ID NO: 599170 - DNA, 516 bp, Homo sapiens
  misc_feature: HIJSMM301EBVCM.49.57.F02.1.454.light.4.raw
agtcgagagacacgaccggtgctcgatttagctcgatatagttgggtttgggggctgtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgccaaaaaaatatgcttgttggtaccagaagaagtcaggccaggccccggtgttgctcatctatgacgacagaaaacgaccctccgggatccctgagagattctctggcctccacctcagggaccatggccacgttgactatcagcggggcccaggtggaggatgaaggtgactactattgttactcaccagacaccagtgaaaatcacagaggaatattcggcggagggaccaagctgaccgtcctaggtcagcccaaggctgccccctcggtcactctgttcccta

SEQ ID NO: 599171 - DNA, 489 bp, Homo sapiens; identical to SEQ ID NO: 535091
  misc_feature: HIJSMM301BMGCU.47.36.D03.1.454.light.4.raw

SEQ ID NO: 599172 - DNA, 504 bp, Homo sapiens; identical to SEQ ID NO: 535077
  misc_feature: HIJSMM301BJEGQ.8.28.C06.1.454.light.4.raw

SEQ ID NO: 599173 - DNA, 505 bp, Homo sapiens
  misc_feature: HIJSMM301E14Y7.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggtcgacgggaccgaacgactggaggagtcaaaccgaaacgtacgtggcgtcgcaccactcttcg

SEQ ID NO: 599174 - DNA, 491 bp, Homo sapiens
  misc_feature: HIJSMM301E1VOM.43.36.D03.1.454.light.4.raw
tgtgagtagtcacgaccggtgctcgatttagctgcgtcacgatctctcttgggggagctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtatccccccacccatcagcacgccttagcctggtaccagcacaagtcagggcagcctcctaagttgctcttttactggacttcgatccgcgcatctggggtccctgaccgattcatgggcagcggctctgggacagacttcgctctcaccatcaacagcctccaggctgaggatgcggcggtttattattgtcaacaatattttagtgctccgtacacttttggccaggggaccaagttggagatcaaacgaactgt

SEQ ID NO: 599175 - DNA, 507 bp, Homo sapiens; identical to SEQ ID NO: 542586
  misc_feature: HIJSMM301BNQCF.8.33.C11.1.454.light.4.raw

SEQ ID NO: 599176 - DNA, 472 bp, Homo sapiens; identical to SEQ ID NO: 536302
  misc_feature: HIJSMM301AVKXN.18.76.G10.1.454.light.4.raw

SEQ ID NO: 599177 - DNA, 482 bp, Homo sapiens
  misc_feature: HIJSMM301CY4R6.13.39.D06.1.454.light.4.raw
tcacgtactacacgaccggtgctcgatttagtgacatctcgcagttctttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacaacacccaggcaaagcccccaaaatcatgatttatgatgtcagtaagcggccctcaggggtccctgatcgcttctctgcctccaagtctggcaacacggcctccctgaccatctctgggctccaggctgaggatgagtctgattattactgctgctcatatgcaggcagctacactgtactattcggcggagggaccaagctgaccgtcctaggt

SEQ ID NO: 599178 - DNA, 486 bp, Homo sapiens; identical to SEQ ID NO: 535385
  misc_feature: HIJSMM301DB13Y.19.71.G05.1.454.light.4.raw

SEQ ID NO: 599179 - DNA, 487 bp, Homo sapiens; identical to SEQ ID NO: 537220
  misc_feature: HIJSMM301CKRD5.16.53.E09.1.454.light.4.raw

SEQ ID NO: 599180 - DNA, 505 bp, Homo sapiens; identical to SEQ ID NO: 551816
  misc_feature: HIJSMM301DKQLE.18.78.H01.1.454.light.4.raw

SEQ ID NO: 599181 - DNA, 505 bp, Homo sapiens; identical to SEQ ID NO: 593691
  misc_feature: HIJSMM301B8RCU.18.59.F04.1.454.light.4.raw

SEQ ID NO: 599182 - DNA, 488 bp, Homo sapiens; identical to SEQ ID NO: 535081
  misc_feature: HIJSMM301DTQKV.26.23.C01.1.454.light.4.raw

SEQ ID NO: 599183 - DNA, 492 bp, Homo sapiens; identical to SEQ ID NO: 537509
  misc_feature: HIJSMM301CN0Q7.13.46.E02.1.454.light.4.raw

SEQ ID NO: 599184 - DNA, 513 bp, Homo sapiens; identical to SEQ ID NO: 535244
  misc_feature: HIJSMM301CKP31.17.33.C11.1.454.light.4.raw

SEQ ID NO: 599185 - DNA, 503 bp, Homo sapiens
  misc_feature: HIJSMM301DS8P7.18.78.H01.1.454.light.4.raw
tacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaacccactgtca

SEQ ID NO: 599186 - DNA, 499 bp, Homo sapiens; identical to SEQ ID NO: 564687
  misc_feature: HIJSMM301DN2PL.43.34.D01.1.454.light.4.raw

SEQ ID NO: 599187 - DNA, 519 bp, Homo sapiens; identical to SEQ ID NO: 597113
  misc_feature: HIJSMM301D4IOA.27.23.C01.1.454.light.4.raw

SEQ ID NO: 599188 - DNA, 496 bp, Homo sapiens
  misc_feature: HIJSMM301CR5BF.3.27.C05.1.454.light.4.raw
agacgcactccacgaccggtgctcgatttagacgcgatcgaagggtttgggggagctacaacaggcaggcaggggcagcaagatggtgttgcagacccaggtcttcatttctctgttgctctggatctctggtgcctacggggacatcgtgatgacccagtccccagactccctggctgtgtctctgggcgagagggccaccatcaactgcaagtccagccagagtgttttatacagctccgacaataagaactacttagcttggtaccagcagaaaccaggacagcctcctaaactgctcatttactgggcatctacccgggaatccgggcccctgaccgattcaatggcagcgggtctggggcagatttcactctcaccatcagcagcctgcaggctgaagatgtggcagtttattactgtcagcaatattatactcctcttccgacgttcggccaggaccaaggtggaatcaaacgaactgtggctgcaccat

SEQ ID NO: 599189 - DNA, 498 bp, Homo sapiens
  misc_feature: HIJSMM301D669N.52.53.E09.1.454.light.4.raw
cgcagtacgacacgaccggtgctcgatttagagagagtgtgttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcggagggaccaagctgaccgtcctaggtcagcccaaggctgccccctcggtcta

SEQ ID NO: 599190 - DNA, 484 bp, Homo sapiens; identical to SEQ ID NO: 535240
  misc_feature: HIJSMM301EQ5OO.47.60.F05.1.454.light.4.raw

SEQ ID NO: 599191 - DNA, 513 bp, Homo sapiens; identical to SEQ ID NO: 535719
  misc_feature: HIJSMM301B6DNN.17.33.C11.1.454.light.4.raw

SEQ ID NO: 599192 - DNA, 503 bp, Homo sapiens
  misc_feature: HIJSMM301CK33P.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgacgtcctgggtcagccaaggctgccccctcggtcta

SEQ ID NO: 599193 - DNA, 482 bp, Homo sapiens; identical to SEQ ID NO: 583104
  misc_feature: HIJSMM301BPUNB.21.25.C03.1.454.light.4.raw

SEQ ID NO: 599194 - DNA, 497 bp, Homo sapiens
  misc_feature: HIJSMM301B0BL7.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagtattttgctactttattactgtcagcagcgtagcaactggcctctctacgtttcggcgggagggaccgagggtggagatcagacgaactgtggctcgcacatctgtt

SEQ ID NO: 599195 - DNA, 499 bp, Homo sapiens
  misc_feature: HIJSMM301C17CR.51.15.B04.1.454.light.4.raw
cgatcgtatacacgaccggtgctcgatttagacagtatatatccgcggggtgatcaggacttctcagttcatcttctcaccatgaggctccctgctcagctcctggggctgctaatgctctgggtcccaggatgcagtggggctgttgtgatgactcagtctccactctccctgcccgtcacccttggacagccggcctccatctcctgcaggtctagtcaaggcctcgtttatagtgatggagacacctacttgagttggtttcaccagaggccaggccaatctccaaggcgcctaatttataaggtttctaaccgggactctggggtcccagacaaattcagcggcagtgggtcaggcactgatttcacactgaaaatcagcagggtggaggctgaggatgttgggatttactactgtatgcaaggtacacactggcctctcactttcgcggagggaccaaggaggaggatgaaacgaaactagtggctgcaccaat

SEQ ID NO: 599196 - DNA, 494 bp, Homo sapiens
  misc_feature: HIJSMM301CGN4L.10.27.C05.1.454.light.4.raw
catagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgcctctttcaaggttttcggcggagggaccaggctgaccgtcctaagtcagcccaaggc

SEQ ID NO: 599197 - DNA, 496 bp, Homo sapiens
  misc_feature: HIJSMM301CFAP6.14.64.F09.1.454.light.4.raw
cgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgcctatttaaattggtatcagcaaaaaccagggaaagcccctaacctcctgatctttgatgcatccaatttgcagagtggggtcccatcacgcttcactggcagtggctctgggacagatttcactctcaccatcagcggtctccaacctgaagattttgcaacttactactgtcaacagagttatgatacccccgtggacgttcggccaggggaccaaggtggagatcaaacgaactagtggctgcaccatctgtcttcatcttcccg

SEQ ID NO: 599198 - DNA, 488 bp, Homo sapiens; identical to SEQ ID NO: 593223
  misc_feature: HIJSMM301EQWP4.11.12.B01.1.454.light.4.raw

SEQ ID NO: 599199 - DNA, 508 bp, Homo sapiens; identical to SEQ ID NO: 552440
  misc_feature: HIJSMM301DF6KP.5.24.C02.1.454.light.4.raw

SEQ ID NO: 599200 - DNA, 491 bp, Homo sapiens; identical to SEQ ID NO: 538021
  misc_feature: HIJSMM301EB0HY.3.72.G06.1.454.light.4.raw

SEQ ID NO: 599201 - DNA, 504 bp, Homo sapiens; identical to SEQ ID NO: 536385
  misc_feature: HIJSMM301A5NNB.27.78.H01.1.454.light.4.raw

SEQ ID NO: 599202 - DNA, 488 bp, Homo sapiens
  misc_feature: HIJSMM301BRN03.15.28.C06.1.454.light.4.raw
tctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcagcggcagtggatctgggacagaattcagtctcaccatcagcagcctgcagcctgacgattttgcaacttactactgccaagtgcataataatcatttcggcggagggaccaaggtggagatcaaaacgaactagtggctgcaccatctgtcttcatt

SEQ ID NO: 599203 - DNA, 493 bp, Homo sapiens; identical to SEQ ID NO: 543929
  misc_feature: HIJSMM301EHJJF.41.16.B05.1.454.light.4.raw

SEQ ID NO: 599204 - DNA, 456 bp, Homo sapiens
  misc_feature: HIJSMM301CHY3D.49.83.H06.1.454.light.4.raw
agtcgagagacacgaccggtgctcgatttagatcacgtgcgtcgcggggtgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggataaatatgctggctggtatcagcagaagccaggccagtcccctgtgttggtcatctatcaagataccaagcggccctcagggatccctgagcgattctctggctccaactctgggaacacagccactctgaccatcagcgggactcaggctatcgatgaggctgactattactgtcaggcgtgggacagccgcactggggtattcggcggagggaccaagctgaccgt

SEQ ID NO: 599205 - DNA, 506 bp, Homo sapiens
  misc_feature: HIJSMM301APB8Y.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaacgcccccaaactcatcatttatgaggtcactaagcggccctcaggggtttctattcgcttctctggctccaagtctgacaacacggcctccctgacaatctctgggctcaggctgaggacgaggctgattattactgctgctcatatgcagatggtgacactcccgtggtattcggcggagggaccaaggtgaccgtcctaggtcagcccaaggctcgtccccccg

SEQ ID NO: 599206 - DNA, 484 bp, Homo sapiens
  misc_feature: HIJSMM301D1N2E.13.36.D03.1.454.light.4.raw
tcacgtactacacgaccggtgctcgatttagctgcgtcacgatctctcttgggggggtcagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggctcctcatttatggtgcatccactagggccactggtgtcccagtcaggttcagcggcagtgggtctgggacagacttcactctcaccatcagcagcctgcagtctgaagatttgcagtctattactgtcagcagtatagttactggagaaccttcggccaagggacacgactggagattaaaggaa

SEQ ID NO: 599207 - DNA, 485 bp, Homo sapiens; identical to SEQ ID NO: 536040
  misc_feature: HIJSMM301A9TE0.15.1.A01.1.454.light.4.raw

SEQ ID NO: 599208 - DNA, 509 bp, Homo sapiens
  misc_feature: HIJSMM301CZPKH.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttgggggtttattactgcatgcaaactacacacggccgctcactttcggcggagggaccgaaggtggaggatcaaacgaactgtggctgcaccatctgtt

SEQ ID NO: 599209 - DNA, 488 bp, Homo sapiens
  misc_feature: HIJSMM301DEMED.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtggggctgaggatgttggcatttattactgcatgcaggctatacaccttcctgccacttttggccaggggaccaaggctggagatcaggcgaacg

SEQ ID NO: 599210 - DNA, 522 bp, Homo sapiens; identical to SEQ ID NO: 540226
  misc_feature: HIJSMM301A26F1.27.23.C01.1.454.light.4.raw

SEQ ID NO: 599211 - DNA, 530 bp, Homo sapiens
  misc_feature: HIJSMM301CUZYH.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtcacggacgaacggtaggaaggtacgaaacgaaacgtagtaggtcgtcgcgaccactactcgtcttctactcttccctccctactcctgtact

SEQ ID NO: 599212 - DNA, 503 bp, Homo sapiens
  misc_feature: HIJSMM301CXM1T.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggactgggaccaaggtcaccgtcctaggtcagcccaaggccaaccctac

SEQ ID NO: 599213 - DNA, 494 bp, Homo sapiens; identical to SEQ ID NO: 534994
  misc_feature: HIJSMM301C435U.27.78.H01.1.454.light.4.raw

SEQ ID NO: 599214 - DNA, 483 bp, Homo sapiens; identical to SEQ ID NO: 535317
  misc_feature: HIJSMM301DWX5H.4.1.A01.1.454.light.4.raw

SEQ ID NO: 599215 - DNA, 476 bp, Homo sapiens
  misc_feature: HIJSMM301BOOW7.13.76.G10.1.454.light.4.raw
tcacgtactacacgaccggtgctcgatttagtcactcatacaggggtgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaagtccagcccaac

SEQ ID NO: 599216 - DNA, 515 bp, Homo sapiens
  misc_feature: HIJSMM301CX59T.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagccctccagtctgaagatgaggctgactattactgtcagacatgggacgctggcgtctggctgttcggcggagggaccaagctgaccgtcctaggtcagccaggctgccccctggtcactctgttcccgcctcctcacg

SEQ ID NO: 599217 - DNA, 491 bp, Homo sapiens; identical to SEQ ID NO: 535294
  misc_feature: HIJSMM301CRFO9.16.68.G02.1.454.light.4.raw

SEQ ID NO: 599218 - DNA, 508 bp, Homo sapiens; identical to SEQ ID NO: 586839
  misc_feature: HIJSMM301CPU1W.47.23.C01.1.454.light.4.raw

SEQ ID NO: 599219 - DNA, 501 bp, Homo sapiens
  misc_feature: HIJSMM301B3UMV.51.14.B03.1.454.light.4.raw
cgatcgtatacacgaccggtgctcgatttagtgtgagtagttccgcggggaggagtcagaccccgtcaggacacagcatggacatgagggtccccgctcagctcctggggctcctgctgctctggttcccaggttccagatgcgacatccaggtgacccagtctccatcctccgtgtctgcatctgtaggagacagagtcaccatgacttgtcgggcgagtcagggtattgacgactacttagcctggcttcagcagaaaccagggaaagcccccaagctcttgatctatgctgcatccaggttggaaagtggggtcccatcaaggttcagcggcagtggatctgggacagatttcactctcaccatcagcagcctgcagcctgaagattttgcaacttattattgtcaacaggctaaaagttaccctctcactttcggcggagggaccaaggtagaaaccaaacgaactgtggctgcaccatctgtcttcatcttccccg

SEQ ID NO: 599220 - DNA, 504 bp, Homo sapiens
  misc_feature: HIJSMM301DGL7G.47.55.E11.1.454.light.4.raw
agctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggccaccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctagggcacgtgagactcaggaaatgaccagaggggagtgaatgaggggtgcagagaactccatggctaccaggtcagcccaaggccaaccccactgtcactctcgttcccgccctcctcta

SEQ ID NO: 599221 - DNA, 493 bp, Homo sapiens; identical to SEQ ID NO: 535084
  misc_feature: HIJSMM301DXK3T.47.64.F09.1.454.light.4.raw

SEQ ID NO: 599222 - DNA, 478 bp, Homo sapiens
  misc_feature: HIJSMM301AQW05.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggcctcaggggtccctgaccgattctctggctccaagtctggcacctcagcctccctggtcatcgctgggctccaggctgacgatgaggctgattattattgccagtcctatgacaacacctgcgtggttttggctgttcggcggcgggac

SEQ ID NO: 599223 - DNA, 511 bp, Homo sapiens; identical to SEQ ID NO: 550512
  misc_feature: HIJSMM301ETHU7.17.2.A02.1.454.light.4.raw

SEQ ID NO: 599224 - DNA, 502 bp, Homo sapiens
  misc_feature: HIJSMM301A5E3C.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactgggctcaggcggaagatgaggctgactattactgtaactcccgggacagcagtgctgaccaggtggtattcggcggagggacccacctgaccgtcttaggtcagcccaaggctcgccccctcggtcta

SEQ ID NO: 599225 - DNA, 524 bp, Homo sapiens
  misc_feature: HIJSMM301DM93X.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcgtttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggcctgccccctcggtcactctgttcccgccct

SEQ ID NO: 599226 - DNA, 519 bp, Homo sapiens
  misc_feature: HIJSMM301A4OKJ.27.23.C01.1.454.light.4.raw
agcgtcgtctcacgaccggtgctcgatttagtacacgtgattagggattgggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaatcagtgacacttgggtgttcggcggagggaccaggctgaccgtcctaggtcagcccaaggctcgccccctcggtcactctgttccccg

SEQ ID NO: 599227 - DNA, 507 bp, Homo sapiens; identical to SEQ ID NO: 536086
  misc_feature: HIJSMM301CGKJP.12.73.G07.1.454.light.4.raw

SEQ ID NO: 599228 - DNA, 487 bp, Homo sapiens; identical to SEQ ID NO: 560802
  misc_feature: HIJSMM301AKVM7.15.1.A01.1.454.light.4.raw

SEQ ID NO: 599229 - DNA, 503 bp, Homo sapiens; identical to SEQ ID NO: 547049
  misc_feature: HIJSMM301AOMJZ.18.59.F04.1.454.light.4.raw

SEQ ID NO: 599230 - DNA, 492 bp, Homo sapiens; identical to SEQ ID NO: 535939
  misc_feature: HIJSMM301A4P6G.13.5.A05.1.454.light.4.raw

SEQ ID NO: 599231 - DNA, 486 bp, Homo sapiens
  misc_feature: HIJSMM301BUHQ0.51.78.H01.1.454.light.4.raw
cgatcgtatacacgaccggtgctcgatttagtgtgagtagtttgggtttggggatgggggcacttctccctctaacactctcccctgttgaagctctttgtgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagagaccagggaaagcccctaacctcctgatctatgatgcatccaatttggaaagtgggtcccatcaaggttcagtggcagtggatctgggacagatttcactctcaccatcagcagtgtgcgacctgaagtattttgcaacttactactgtcaacagagttacagtaccctcagctcactttcggcggagggaccaaggtggagatcaaacgaa

SEQ ID NO: 599232 - DNA, 504 bp, Homo sapiens
  misc_feature: HIJSMM301DG4UE.48.73.G07.1.454.light.4.raw
  modified_base (423)..(423): a, c, t, g, unknown or other
agtatacatacacgaccggtgctcgatttagctctacgctcagggcacgaccggtgctcgatttagtctgacgtcaaagggaaagggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagntgctgcaacctattactgtcatcagtacttttagtttacgtcggaccttcggccaagggacacgactggagattaaacgaa

SEQ ID NO: 599233 - DNA, 486 bp, Homo sapiens
  misc_feature: HIJSMM301CRYNN.49.12.B01.1.454.light.4.raw
agtcgagagacacgaccggtgctcgatttagtagtgtagattccgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtatttactttcaccatcatcaacctgcagcctgaggatattgcaacatattactgtcaacaatatgataatctaccactcactttcggcggagggaccacggtggagatcaaacgaactagtggctgcaccatctgtcttcta

SEQ ID NO: 599234 - DNA, 494 bp, Homo sapiens; identical to SEQ ID NO: 545671
  misc_feature: HIJSMM301DA40V.9.1.A01.1.454.light.4.raw

SEQ ID NO: 599235 - DNA, 494 bp, Homo sapiens; identical to SEQ ID NO: 534992
  misc_feature: HIJSMM301E2S1H.9.1.A01.1.454.light.4.raw

SEQ ID NO: 599236 - DNA, 445 bp, Homo sapiens; identical to SEQ ID NO: 555159
  misc_feature: HIJSMM301EFTQ9.5.9.A09.1.454.light.4.raw

SEQ ID NO: 599237 - DNA, 518 bp, Homo sapiens; identical to SEQ ID NO: 535407
  misc_feature: HIJSMM301BG1C3.22.30.C08.1.454.light.4.raw

SEQ ID NO: 599238 - DNA, 488 bp, Homo sapiens
  misc_feature: HIJSMM301AOUBO.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcagtgggtcaggcgctgatttcacactgagaatcagcagggtggaggctgaagatgtcgggtttattactgcatgcagggtacagtgtggccttcgctcgcattcggcggagggaccgaaggtggagatcaaacgaa

SEQ ID NO: 599239 - DNA, 487 bp, Homo sapiens; identical to SEQ ID NO: 536196
  misc_feature: HIJSMM301CQ5E7.11.28.C06.1.454.light.4.raw

SEQ ID NO: 599240 - DNA, 514 bp, Homo sapiens
  misc_feature: HIJSMM301ATLWK.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccgaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctggtcactctgtcccaccctcctcgctacgtagac

SEQ ID NO: 599241 - DNA, 513 bp, Homo sapiens
  misc_feature: HIJSMM301CZLQG.48.23.C01.1.454.light.4.raw
agtatacatacacgaccggtgctcgatttagtacacgtgattagggttggggagagaagacaggactcaggacaatctccagcatggccagcttccctctcctcctcaccctcctcactcactgtgcagggtcctgggcccagtctgtgctgactcagccaccctcagcgtctgggacccccggtcagagtgtcaccatctcttgttctggaagcggctccaacatcggaagaaatactgtgaactggtaccagcagctcccaggagcggcccccagactctacatctataataattatcgccggccctcaggggtccctgaccgagtctctgcctccaagtctggcacctcagcctccctggccatcagtggcctccggtctgaagaggagggtgattattactgtgcagcgtgggatgacagcctgaatgcttgggtgttcgggcggagggaccaagttgaccgtcctaggtcaacccaaggctgccccctcggtcactctgttcccgcct

SEQ ID NO: 599242 - DNA, 499 bp, Homo sapiens; identical to SEQ ID NO: 542528
  misc_feature: HIJSMM301CDDS0.52.34.D01.1.454.light.4.raw

SEQ ID NO: 599243 - DNA, 486 bp, Homo sapiens; identical to SEQ ID NO: 535043
  misc_feature: HIJSMM301B4K31.46.35.D02.1.454.light.4.raw

SEQ ID NO: 599244 - DNA, 488 bp, Homo sapiens
  misc_feature: HIJSMM301A0J31.49.52.E08.1.454.light.4.raw
agtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatctgcggacagcagtggttctcatgtggtattcggcggagggaccaagctgaccgtcctaggtcagcccaaggctccg

SEQ ID NO: 599245 - DNA, 515 bp, Homo sapiens
  misc_feature: HIJSMM301CB4Z0.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgttcggccagggaccgacacgtagaaagtagagacgaactacgtggcgtgcgaccaactctcgtcttctacttcttcccgt

SEQ ID NO: 599246 - DNA, 493 bp, Homo sapiens
  misc_feature: HIJSMM301BYTF7.13.56.F01.1.454.light.4.raw
tcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaagagccaccctctcctgcagggccagtcagacagttagcaacaacgtagcctggtaccagcagaaacgtggccaggctcccaggctcctcatctatggtgcatccaccagggccactggtatcccagaccggttcagtggcagtgggtctgggacagacttcactctcaccatcagcagtctgcagtctgaagattttgcagtttattactgtcagcagtataataactggcctcgtacatgtacacttttggccgtagggaccaacctggagatcagacgaa

SEQ ID NO: 599247 - DNA, 480 bp, Homo sapiens
  misc_feature: HIJSMM301CVYST.11.11.A11.1.454.light.4.raw
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcaccccggagtcccctgaccgattcagtggcagcgggtctgggacagacttcactctcaccatcagcaacctgcaggctgaagatgtggcagtttattactgtcagcagtattgtgaagctccgctcactttcggcggagggaccgcggtggagatcagacgaactgtggctgcaccatctgtctt

SEQ ID NO: 599248 - DNA, 492 bp, Homo sapiens
  misc_feature: HIJSMM301B4067.18.11.A11.1.454.light.4.raw
  modified_base (470)..(470): a, c, t, g, unknown or other
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccntctgtcttcatcttcccgccat

SEQ ID NO: 599249 - DNA, 500 bp, Homo sapiens
  misc_feature: HIJSMM301AVVMA.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggtccaacgggaccgagggtgggaaagtacaaacgaactacgtggctgcaccatctgtcttc

SEQ ID NO: 599250 - DNA, 520 bp, Homo sapiens
  misc_feature: HIJSMM301C0MZC.12.71.G05.1.454.light.4.raw
atacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgaggacactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagcccaaggctgccccctcggtcactctgttcccacct

SEQ ID NO: 599251 - DNA, 503 bp, Homo sapiens
  misc_feature: HIJSMM301BQXKJ.27.78.H01.1.454.light.4.raw
agcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctgaaggggctgaagatgctgcaacttattacttgtcatcagagtactactttaccttcaagtgatcaccttcggccaacggaacgacgactgagattaaacgaactagtggcgtgcaccactctgtt

SEQ ID NO: 599252 - DNA, 506 bp, Homo sapiens
  misc_feature: HIJSMM301BNKTF.13.25.C03.1.454.light.4.raw
tcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatcttgggacttatagacttgtctcctggtaccaacaccacccaggcaaggcccccagagtcatcatttatgggggcaataggcggccgtcagggatttccactcgcttctctggctccaagtctggcaacacggcctccctgacaatctctggtctccaggctgaggacgaggctgcctattactgctgctcatatgcaggttcttctgtggtcttcggcggagggtccaaagtgaccgtcctaggtcagcccaaggctgccccctcggtccact

SEQ ID NO: 599253 - DNA, 494 bp, Homo sapiens; identical to SEQ ID NO: 539894
  misc_feature: HIJSMM301EGDPB.16.53.E09.1.454.light.4.raw

SEQ ID NO: 599254 - DNA, 498 bp, Homo sapiens
  misc_feature: HIJSMM301B52FT.2.76.G10.1.454.light.4.raw
acgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgaccccaaactcctcatctctcacaataatcagcggccctcaggagtccctgaccgattctctgcctccaagtccggcacctcagcctccctggccatcagtgggctccgggccgaggatgaggctgattattactgtgcaggatgggatgacaacctgggtgcttatctcttcggacctgggaccaaggtcaccgtcctt

SEQ ID NO: 599255 - DNA, 534 bp, Homo sapiens
  misc_feature: HIJSMM301BWJTD.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccgaacgggaccgaaacggtagggaaggtacgaaacggaaacctacgtaggtcgtgtcgaccaactctcgtcttctactcttcccgtcccact

SEQ ID NO: 599256 - DNA, 493 bp, Homo sapiens; identical to SEQ ID NO: 535047
  misc_feature: HIJSMM301ELYZX.16.53.E09.1.454.light.4.raw

SEQ ID NO: 599257 - DNA, 444 bp, Homo sapiens; identical to SEQ ID NO: 534993
  misc_feature: HIJSMM301CKSEA.5.9.A09.1.454.light.4.raw

SEQ ID NO: 599258 - DNA, 503 bp, Homo sapiens
  misc_feature: HIJSMM301D4S9Z.48.67.G01.1.454.light.4.raw
agtatacatacacgaccggtgctcgatttagagtatacatattgggtttggggggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggttttattactgtcagcagcgtgccaactggcctctcacgttcggcggagggaccaagggtggacatcaaacgaactgtggctgcaccatctgtcttcatcttcccg

SEQ ID NO: 599259 - DNA, 486 bp, Homo sapiens; identical to SEQ ID NO: 535385
  misc_feature: HIJSMM301EJZOE.19.71.G05.1.454.light.4.raw

SEQ ID NO: 599260 - DNA, 502 bp, Homo sapiens
  misc_feature: HIJSMM301ETBKI.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctcggggccactttcggcctgggaccaaattgagatcaaacgaactgtggctgcaccatctgtcttcatcttcccgccat

SEQ ID NO: 599261 - DNA, 500 bp, Homo sapiens
  misc_feature: HIJSMM301EB8UZ.51.26.C04.1.454.light.4.raw
cgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggctgcgattttcggcggtagggaccagtctgaccgtcctaggtcagcccaaggctgccccctcggtcactctcg

SEQ ID NO: 599262 - DNA, 492 bp, Homo sapiens; identical to SEQ ID NO: 535939
  misc_feature: HIJSMM301CLT39.13.5.A05.1.454.light.4.raw

SEQ ID NO: 599263 - DNA, 479 bp, Homo sapiens
  misc_feature: HIJSMM301BPTY8.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagattttgcaacttactattgtcaacaggctaacagtttcccgctcaccttcggcgggggaccaagggtggagatcaaacgaactgtggctgcacc

SEQ ID NO: 599264 - DNA, 505 bp, Homo sapiens
  misc_feature: HIJSMM301C667I.19.71.G05.1.454.light.4.raw
tactctcgtgcacgaccggtgctcgatttagtgtcgtcgcaagagagaggggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtgggacgttcggtccgaagggaccgaaggtagggatatacagacgaactagtgggctgca

SEQ ID NO: 599265 - DNA, 504 bp, Homo sapiens; identical to SEQ ID NO: 562026
  misc_feature: HIJSMM301DSW0T.9.71.G05.1.454.light.4.raw

SEQ ID NO: 599266 - DNA, 495 bp, Homo sapiens; identical to SEQ ID NO: 537716
  misc_feature: HIJSMM301DCN6J.22.14.B03.1.454.light.4.raw

SEQ ID NO: 599267 - DNA, 486 bp, Homo sapiens; identical to SEQ ID NO: 544134
  misc_feature: HIJSMM301AZPRU.17.26.C04.1.454.light.4.raw

SEQ ID NO: 599268 - DNA, 512 bp, Homo sapiens
  misc_feature: HIJSMM301DK8WA.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgtggccagtcagagcgttaggacgaacttagcctggtatcggcagaggcctggccaggctcccagactcctcatctttggcgcctttaacagggccagtggaatcccagccaggttcagcggcagtgggtctgggacttcgttcactctcaccatcagcagcctagagcctgaagattttgcagtttattactgtcaacatcgtaccgagtggcctccgggggccactttcggccctgggaccaaaattgagatcaaacgaaactgtggctgcaccatctgtcttcatcttcccgcc

SEQ ID NO: 599269 - DNA, 521 bp, Homo sapiens
  misc_feature: HIJSMM301CQ8JO.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagccaaggctgccccctcggtcactctcgttcccaccct

SEQ ID NO: 599270 - DNA, 490 bp, Homo sapiens
  misc_feature: HIJSMM301CBHCX.17.67.G01.1.454.light.4.raw
cgtagactagcacgaccggtgctcgatttagagtatacatattgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagggtcaccatcacttgccgggcaagtcacagcattagcagctatttaaattggtatcagcagaaaccagggagagcccctaacctcctgatctatgctgcatccagtttgcagagtgggtcccatcaaggttcagtggcagtggatctgggacagatttcactctcaccatcagcagtctgcaacctgaagattttgcaacttactactgtcaacagagtctcagtaccccccggacgttccggtccgacgggaccgacgggtggaaagtacaaacgaactacgtggctg

SEQ ID NO: 599271 - DNA, 503 bp, Homo sapiens
  misc_feature: HIJSMM301CHB0L.4.6.A06.1.454.light.4.raw
agcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtctggggcccccgggcagagggtcatcctctcttgttctggaggcagctccaacatcggaggacatcctgtgagctggtaccaacacctcccaggaacggcccccaaactcctcatctatacagattctaagaggcccgcaggggtcccagatcgattctctggctccaggtctggcacctcagcctccctgtccatcagtggactccggtctgaggatgaggctgactactattgttcaggatgggatttacagcctacatgctcggctgttcggcggagggaccaaactgaccgtcttaggtcagcccaaggctgccccccg

SEQ ID NO: 599272 - DNA, 518 bp, Homo sapiens
  misc_feature: HIJSMM301DQOVY.49.10.A10.1.454.light.4.raw
agtcgagagacacgaccggtgctcgatttagcgtcgatctcaggggagtctgggcctaaggaagcagcactggtggtgcctcagccatggcctggaccgttctcctcctcggcctcctctctcactgcacagactctgtgacctcctatgttctgactcagccgccctcggcgtcagtggccccaggacagacggccacgattccctgtaggggagacgacattggagggaaagctgtgcattggtaccagcagaagccaggccaggcccctgagctggtcctccatggtgatagcgaccggccctcaggaatccctgagagattctccggctccaactctggggagatggccaccctgacccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccaccctcctctct

SEQ ID NO: 599273 - DNA, 505 bp, Homo sapiens
  misc_feature: HIJSMM301BQ8WZ.3.10.A10.1.454.light.4.raw
  modified_base (440)..(440): a, c, t, g, unknown or other
  modified_base (449)..(449): a, c, t, g, unknown or other
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattaattgtcaatcagcagacaacaagtaataacttatactttattgtnttcggtatntggtccacgggtacgaccgtcctacggttcagacccaacgacgaaccccaccctac

SEQ ID NO: 599274 - DNA, 505 bp, Homo sapiens; identical to SEQ ID NO: 535987
  misc_feature: HIJSMM301D0G6V.18.37.D04.1.454.light.4.raw

SEQ ID NO: 599275 - DNA, 516 bp, Homo sapiens
  misc_feature: HIJSMM301CZPMU.41.25.C03.1.454.light.4.raw
tctatactatcacgaccggtgctcgatttagtagtgtagatttgggtttgggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagatttttcgaagactccctggggtccctttcggttttctggctccatcgacagtccctccaactccgcctcccttaccatatctgggctgaagagtgaggacgaggctgactacttctgtcagtcttatgatataaacaattatgtgataattggcggagggccaggtgaccgtcctaggtcagcccaaggctgccccctcggtcactctgttcccg

SEQ ID NO: 599276 - DNA, 503 bp, Homo sapiens; identical to SEQ ID NO: 538884
  misc_feature: HIJSMM301BA55J.27.78.H01.1.454.light.4.raw

SEQ ID NO: 599277 - DNA, 480 bp, Homo sapiens; identical to SEQ ID NO: 555208
  misc_feature: HIJSMM301D3GYU.21.25.C03.1.454.light.4.raw

SEQ ID NO: 599278 - DNA, 515 bp, Homo sapiens; identical to SEQ ID NO: 536247
  misc_feature: HIJSMM301C3QF7.14.19.B08.1.454.light.4.raw

SEQ ID NO: 599279 - DNA, 496 bp, Homo sapiens; identical to SEQ ID NO: 537925
  misc_feature: HIJSMM301A3RPM.22.14.B03.1.454.light.4.raw

SEQ ID NO: 599280 - DNA, 514 bp, Homo sapiens; identical to SEQ ID NO: 540552
  misc_feature: HIJSMM301A28GE.16.66.F11.1.454.light.4.raw

SEQ ID NO: 599281 - DNA, 480 bp, Homo sapiens; identical to SEQ ID NO: 535442
  misc_feature: HIJSMM301DS7H9.41.17.B06.1.454.light.4.raw

SEQ ID NO: 599282 - DNA, 475 bp, Homo sapiens
  misc_feature: HIJSMM301A5YL0.52.8.A08.1.454.light.4.raw
cgcagtacgacacgaccggtgctcgatttagcatactctacagggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgtagcctgaagatattgcaacatattactgtcaacagtatgatagtctcccgctcactttcggtcgggggaccgaaggtggaggatcaagcgaactgtggctgca

SEQ ID NO: 599283 - DNA, 460 bp, Homo sapiens
  misc_feature: HIJSMM301C6IH9.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgtagcatgggattacaacctgagtgatcctagttgggtgttcggcggagggaccaggctgaccgtcctaggtcagcccaaggctgccccctcggtcactctgttcccgccctcctcacgcgtatgt

SEQ ID NO: 599284 - DNA, 512 bp, Homo sapiens
  misc_feature: HIJSMM301ESZAZ.19.85.H08.1.454.light.4.raw
tactctcgtgcacgaccggtgctcgatttagtatcactcagtcgcggggtccaaacagagcttcagcaagcatagtgggaatctgcaccatgccctgggctctgcttcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaaatacagcctctctgaccattactggtctccagcctgacgacgaggctgactactactgctcagcctgggacaccagcctcgctgcttggcttttcggcggagggaccaagctgaccgtccgtgggtcagcccaaggctcgccccctcggtcctacc

SEQ ID NO: 599285 - DNA, 509 bp, Homo sapiens
  misc_feature: HIJSMM301A66XF.47.85.H08.1.454.light.4.raw
  modified_base (502)..(502): a, c, t, g, unknown or other
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacgcctccctgaccatctctgggctcgagtctgaggacgaggctgattacttctgttgctcttgggcaactactgtcgtttgggtgttcggcggagggaccaagttgaccgtctaggtcagcccaaggctcgccccctcggtacnctctcgt

SEQ ID NO: 599286 - DNA, 485 bp, Homo sapiens; identical to SEQ ID NO: 538533
  misc_feature: HIJSMM301AUXMV.47.78.H01.1.454.light.4.raw

SEQ ID NO: 599287 - DNA, 494 bp, Homo sapiens; identical to SEQ ID NO: 556280
  misc_feature: HIJSMM301B5SVC.12.87.H10.1.454.light.4.raw

SEQ ID NO: 599288 - DNA, 520 bp, Homo sapiens
  misc_feature: HIJSMM301AWH16.12.71.G05.1.454.light.4.raw
atacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaagtgaccgtcctaagtcagcccaaggctgccccctcggtcactctgttcccgccct

SEQ ID NO: 599289 - DNA, 488 bp, Homo sapiens
  misc_feature: HIJSMM301D3KKS.51.38.D05.1.454.light.4.raw
cgatcgtatacacgaccggtgctcgatttagtatctgatagttgggtttgggggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcatatacaatcaataacaattgggtgttcggcggagggaccaaactgaccgtcctaggtcagcccaaggctgccccctcggtcactctgttcccaccctcctctcgtagcact

SEQ ID NO: 599290 - DNA, 497 bp, Homo sapiens; identical to SEQ ID NO: 554406
  misc_feature: HIJSMM301EL516.3.33.C11.1.454.light.4.raw

SEQ ID NO: 599291 - DNA, 491 bp, Homo sapiens
  misc_feature: HIJSMM301BHUSC.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgctagtttattactgtcagcagtataattactggcctcggacgttcgccagggaccaaggtaggaagtacaacgaactgtggctgcaccatctgtctt

SEQ ID NO: 599292 - DNA, 494 bp, Homo sapiens; identical to SEQ ID NO: 534994
  misc_feature: HIJSMM301EFWTG.27.78.H01.1.454.light.4.raw

SEQ ID NO: 599293 - DNA, 516 bp, Homo sapiens
  misc_feature: HIJSMM301DQ0QS.40.30.C08.1.454.light.4.raw
tctagcgactcacgaccggtgctcgatttagtctgacgtcaaagggaaagggcacgaccggtgctcgatttagtacgtcatcagggaaagggggaagagctgctcagttaggacccagagggaaccatggaaaccccagcgcagcttctcttcctcctgctactctggctcccagagacccccggagaaattgtgttgacgcagtctccaggcaccctgtctttgtctccaggggaaagagccaccctctcctgcagggccagtcagagtgtaaccaacaactacttaatgtggtaccagcaaaaacctggccaggctcccaggctcctcatctatggtgcatccaacagggccagtggcatcccagacaggtttagaggcagtggggccgacacagacttcactctcaccatcagcagactggagcctgaagattttgcactgtattactgtcaccagtctgctcacgtacctctcactttcggcggagggaccaaggtggagatcaaacgaact

SEQ ID NO: 599294 - DNA, 495 bp, Homo sapiens
  misc_feature: HIJSMM301EHIF9.15.31.C09.1.454.light.4.raw
tctacgtagccacgaccggtgctcgatttagacgtctcatcaaggaaggaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcttggacagtcgatcaccatctcctgcactggaaccagcagtgacgttggtacttataactatgtctcctggtaccaacagaacccaggcaaagcccccaaactcatgatttatgaggtcagtaatcggccctcaggggtttctaatcgcttctctggctccaagtctggcaacatggcctcctgaccatctctgggctccaggctgaggacgaggctgattattactgcagctcatatacaagcagcagcactccttgggtgttcggcggagggaccaagctgaccgtcctaggtcagcccaagg

SEQ ID NO: 599295 - DNA, 491 bp, Homo sapiens; identical to SEQ ID NO: 542310
  misc_feature: HIJSMM301ELBX2.22.65.F10.1.454.light.4.raw

SEQ ID NO: 599296 - DNA, 485 bp, Homo sapiens; identical to SEQ ID NO: 536576
  misc_feature: HIJSMM301C70NE.46.35.D02.1.454.light.4.raw

SEQ ID NO: 599297 - DNA, 501 bp, Homo sapiens
  misc_feature: HIJSMM301CUO70.17.61.F06.1.454.light.4.raw
  modified_base (461)..(461): a, c, t, g, unknown or other
cgtagactagcacgaccggtgctcgatttagctacgctctaagggaaaggggcttcagggacctctgggctgatccttggtctcctgctcctcaggctcaccggggcccagcacagactcactggcatgtgtttctccctctttccagggtcctgggcccagtctgccctgactcagcctgcctccgtgtctgggtctcttggacagtcgatcaccatctcctgcactggaaccagcagtgacgttggtacttataactatgtctcctggtaccaacagaacccaggcaaagcccccaaactcatgatttatgaggtcagtaatcggccctcaggggtttctaatcgcttctctggctccaagtctggcaacatggcctcctgaccatctctgggctccaggctgaggacgaggctgattattactgcagctcatatacaagcagcagcactccttgggtnttcggcggaggaccaagctgaccgtcctaggtcagcccaa

SEQ ID NO: 599298 - DNA, 510 bp, Homo sapiens; identical to SEQ ID NO: 546105
  misc_feature: HIJSMM301AIOO1.9.37.D04.1.454.light.4.raw

SEQ ID NO: 599299 - DNA, 521 bp, Homo sapiens
  misc_feature: HIJSMM301CJAMC.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgtttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccacct

SEQ ID NO: 599300 - DNA, 484 bp, Homo sapiens; identical to SEQ ID NO: 551914
  misc_feature: HIJSMM301D26BM.17.39.D06.1.454.light.4.raw

SEQ ID NO: 599301 - DNA, 497 bp, Homo sapiens
  misc_feature: HIJSMM301EBRQ9.7.5.A05.1.454.light.4.raw
cgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggttcctaatcgcttctctggctccaagtctggcgacacggcctccctcgaccatctctgggctccaggctgaagacgaggctgattattactgcagctcatatacaggcagcagcactcaggttttcggcggagggaccaagctgaccgtcctaggtcagcccaaggctgccccctcggt

SEQ ID NO: 599302 - DNA, 481 bp, Homo sapiens; identical to SEQ ID NO: 535993
  misc_feature: HIJSMM301BI1QE.21.25.C03.1.454.light.4.raw

SEQ ID NO: 599303 - DNA, 488 bp, Homo sapiens
  misc_feature: HIJSMM301BLSUT.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcatgcacagattttacactgaaaatcagcagagtggaggctgaggatgttgggctctattattgcatgcaagctctacaagtcccgctcactttcggcggagggaccgaaggtggagatcaaacgtaacg

SEQ ID NO: 599304 - DNA, 517 bp, Homo sapiens
  misc_feature: HIJSMM301BVNBT.16.83.H06.1.454.light.4.raw
tgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtgggggaaacggccttggacgtaaaagtgtgcactggtaccagcagaagccaggccaggcccctgtgctggtcgtctatgatgatagcgaccggccctcagggatccctgagcgattctctggctccaactctgggaacgcggccaccctgaccatcagcagggtcgaagccggggatgaggccgactattactgtcaggtgtgggatagtagtagtgatcattatgtcttcggatctgggaccagggtcaccgtcctaggtcagcccaaggccaaccccactgtcactctcgttcccgccctccc

SEQ ID NO: 599305 - DNA, 489 bp, Homo sapiens
  misc_feature: HIJSMM301CO1OI.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggggttatcaccttgtctcctggtaccaacaccaccccggcagacgcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctcgttcccaccctcctcgcctacgtaga

SEQ ID NO: 599306 - DNA, 505 bp, Homo sapiens; identical to SEQ ID NO: 536233
  misc_feature: HIJSMM301DWZ7Z.48.25.C03.1.454.light.4.raw

SEQ ID NO: 599307 - DNA, 507 bp, Homo sapiens; identical to SEQ ID NO: 568140
  misc_feature: HIJSMM301EBJVQ.10.27.C05.1.454.light.4.raw

SEQ ID NO: 599308 - DNA, 493 bp, Homo sapiens; identical to SEQ ID NO: 535047
  misc_feature: HIJSMM301BJ1SR.16.53.E09.1.454.light.4.raw

SEQ ID NO: 599309 - DNA, 479 bp, Homo sapiens
  misc_feature: HIJSMM301CT1J0.41.17.B06.1.454.light.4.raw
tctatactatcacgaccggtgctcgatttagtcgatagtgaagggggaggaactgctcagttaggacccagacggaaccatggaagccccagcgcagcttctcttcctcctgctactctggctcccagatatcacaggagagatagtgatgacgcagtctccagccaccctgtctctgtctccaggggaaagagcctccctctcctgcagggccagtcagaatattcgcggccacttagcctggtatcagcagaaacctggccaggctcccaggctcctcatctatgctgcatccaccagggccactggtatcccagccaggttcagtggcggtgggtctgggacagagtttactctcaccatcaacggcctgcagtctgaagattctgcagtttattactgtcagcagtatgttgactggcctccgctcactttcggcggagggaccaaggtggagatcagacgaactgtggctgcac

SEQ ID NO: 599310 - DNA, 487 bp, Homo sapiens
  misc_feature: HIJSMM301ASXYF.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggtccgaagggaccaacggtggaaagtacaaacgaactagtggctgcaccta

SEQ ID NO: 599311 - DNA, 496 bp, Homo sapiens
  misc_feature: HIJSMM301DWE7M.51.5.A05.1.454.light.4.raw
cgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaaatctgctttttggtaccatcagaggccaggccaggcccctgtattggtcatctatgaggacaccaagcgaccctccggaatccctgagagagtcgctggctccaggtcagggacaatggccaccttgactatcactgggacccagatggacgatgaaggtgactaccactgttattcgacagacagcagtggtagtcgagggggtcttcggcggagggacgaagctgaccgtcctgagtcagcccaaggctgccccctggtcactc

SEQ ID NO: 599312 - DNA, 508 bp, Homo sapiens; identical to SEQ ID NO: 578624
  misc_feature: HIJSMM301EQSEV.47.23.C01.1.454.light.4.raw

SEQ ID NO: 599313 - DNA, 496 bp, Homo sapiens
  misc_feature: HIJSMM301BPXKQ.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggtcggggggaccaagctggagatcaaccgaactgtggctgcaccatctgtt

SEQ ID NO: 599314 - DNA, 505 bp, Homo sapiens
  misc_feature: HIJSMM301EGLJY.5.24.C02.1.454.light.4.raw
atcagacacgcacgaccggtgctcgatttagtacagatcgttagggaaagggggctggggtctcaggaggcagcgctctcaggacgtcaccaccatggtcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaaggctgaccgtcctaggtcagcccaaggccg

SEQ ID NO: 599315 - DNA, 498 bp, Homo sapiens
  misc_feature: HIJSMM301EOUS0.15.25.C03.1.454.light.4.raw
  modified_base (493)..(493): a, c, t, g, unknown or other
tctacgtagccacgaccggtgctcgatttagtagtgtagatttgggtttgggggatcaggactcctcatttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatcagcagagtggaggctgaggacgttggggtttattactgcatgcaaggtctacaaaccccgatcaccttcggccgagggacacgcctggagattaaacgaactgtggctgnaccat

SEQ ID NO: 599316 - DNA, 492 bp, Homo sapiens; identical to SEQ ID NO: 534967
  misc_feature: HIJSMM301EUK4R.47.64.F09.1.454.light.4.raw

SEQ ID NO: 599317 - DNA, 510 bp, Homo sapiens
  misc_feature: HIJSMM301D3V1M.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcgggcgttcggccgaacgggaccgaaggtggaaagtacaaaacgaaactgtggctgcaccatctgtcttcatcttccccg

SEQ ID NO: 599318 - DNA, 501 bp, Homo sapiens; identical to SEQ ID NO: 560349
  misc_feature: HIJSMM301DO455.18.26.C04.1.454.light.4.raw

SEQ ID NO: 599319 - DNA, 508 bp, Homo sapiens
  misc_feature: HIJSMM301BDMKH.3.79.H02.1.454.light.4.raw
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaagcccccaaactcatcatttatgatgtcactgctcggccctcaggggtttctcatcgcttttctggctccaagtctggcaccacggcctccctgacccatctcggggctccaggctgaggacgaggctgcttattactgcagctcatatacaaggagcaccactctcgtggtatttggtggagggaccaagctgaccgtcctaggtcagtccaaggctgccccctcggt

SEQ ID NO: 599320 - DNA, 538 bp, Homo sapiens
  misc_feature: HIJSMM301EK9AB.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgcccccccgaccgtactccctaccggtccggaaccggaacggaccgacgacgtagggaattaaacgttaaaaccgacgttgggtcgtcgtcgacccaacctacttcgttcgtttccttacta

SEQ ID NO: 599321 - DNA, 448 bp, Homo sapiens
  misc_feature: HIJSMM301B83JM.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcgggatctgggaccaaggtcaccgtcctaagtcagcccaaggccaacccctctgtcactctgttcccaccctcctccatactcgta

SEQ ID NO: 599322 - DNA, 477 bp, Homo sapiens; identical to SEQ ID NO: 535266
  misc_feature: HIJSMM301A7DCL.4.34.D01.1.454.light.4.raw

SEQ ID NO: 599323 - DNA, 454 bp, Homo sapiens; identical to SEQ ID NO: 535005
  misc_feature: HIJSMM301DXHPK.19.86.H09.1.454.light.4.raw

SEQ ID NO: 599324 - DNA, 517 bp, Homo sapiens
  misc_feature: HIJSMM301A7KZH.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcacctttatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgttcgtccacgggaccgaccacgtagaaatagagacgaacgtagtggtcgtgcgaccactctgtcttctactcttcccgt

SEQ ID NO: 599325 - DNA, 524 bp, Homo sapiens; identical to SEQ ID NO: 561490
  misc_feature: HIJSMM301DW92P.53.77.G11.1.454.light.4.raw

SEQ ID NO: 599326 - DNA, 507 bp, Homo sapiens; identical to SEQ ID NO: 557429
  misc_feature: HIJSMM301B0QI5.15.59.F04.1.454.light.4.raw

SEQ ID NO: 599327 - DNA, 484 bp, Homo sapiens; identical to SEQ ID NO: 535400
  misc_feature: HIJSMM301DZMWM.46.26.C04.1.454.light.4.raw

SEQ ID NO: 599328 - DNA, 493 bp, Homo sapiens; identical to SEQ ID NO: 544835
  misc_feature: HIJSMM301CK758.43.29.C07.1.454.light.4.raw

SEQ ID NO: 599329 - DNA, 504 bp, Homo sapiens
  misc_feature: HIJSMM301D0K8K.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacggggacgcaacatgggatgacaatctgagcggttgggtgttcggcggaggggaccaaactgaccgtcctaggtcagcccaa

SEQ ID NO: 599330 - DNA, 482 bp, Homo sapiens
  misc_feature: HIJSMM301DIEDG.14.53.E09.1.454.light.4.raw
cgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcggtgttcggcggaggaccaagctgaccgtcctaggtcagcccaaggctgcccctcggtcac

SEQ ID NO: 599331 - DNA, 494 bp, Homo sapiens; identical to SEQ ID NO: 534992
  misc_feature: HIJSMM301BUV7A.9.1.A01.1.454.light.4.raw

SEQ ID NO: 599332 - DNA, 508 bp, Homo sapiens; identical to SEQ ID NO: 560515
  misc_feature: HIJSMM301EBS2X.17.33.C11.1.454.light.4.raw

SEQ ID NO: 599333 - DNA, 485 bp, Homo sapiens; identical to SEQ ID NO: 536040
  misc_feature: HIJSMM301CNOO0.15.1.A01.1.454.light.4.raw

SEQ ID NO: 599334 - DNA, 485 bp, Homo sapiens
  misc_feature: HIJSMM301A8CRL.17.25.C03.1.454.light.4.raw
cgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaaatctcaccatcaccactctgcaacctgaggattgtgcaatctactactgtcaacagagttacagttcccctcgcacttttggccagggaccaaagttgagatcaaacgaactgtggctgcaccatctgt

SEQ ID NO: 599335 - DNA, 478 bp, Homo sapiens; identical to SEQ ID NO: 535129
  misc_feature: HIJSMM301BHSU9.11.11.A11.1.454.light.4.raw

SEQ ID NO: 599336 - DNA, 415 bp, Homo sapiens
  misc_feature: HIJSMM301C4TSY.18.78.H01.1.454.light.4.raw
tacgagtatgcacgaccggtgctcgatttagtgtgagtagtttgggtttgggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcagggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcactctgttcccgccctcctccatactcgta

SEQ ID NO: 599337 - DNA, 519 bp, Homo sapiens
  misc_feature: HIJSMM301DERZ5.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccgaagggggacgggatccccgatcgcttcatgggctccagttctggggctgaccgctacctcaccatctccaacctccagtctgacgatgaggctgagtatcactggtggagagagccacacaattgatggtcaaggcggttgggtgttcggcggagggaccaagctgaccgtcctaggtcagcccaaggctcgccccctcggtcactctcgttccccaccctcctcgctacgtagac

SEQ ID NO: 599338 - DNA, 493 bp, Homo sapiens; identical to SEQ ID NO: 549048
  misc_feature: HIJSMM301BIBUO.16.86.H09.1.454.light.4.raw

SEQ ID NO: 599339 - DNA, 491 bp, Homo sapiens; identical to SEQ ID NO: 538021
  misc_feature: HIJSMM301CVGFW.3.72.G06.1.454.light.4.raw

SEQ ID NO: 599340 - DNA, 491 bp, Homo sapiens; identical to SEQ ID NO: 543050
  misc_feature: HIJSMM301CWQ6C.10.72.G06.1.454.light.4.raw

SEQ ID NO: 599341 - DNA, 490 bp, Homo sapiens
  misc_feature: HIJSMM301A24GJ.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaaggccaaccccc

SEQ ID NO: 599342 - DNA, 512 bp, Homo sapiens
  misc_feature: HIJSMM301CR33Z.13.55.E11.1.454.light.4.raw
tcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcaccatcacttgccgggcaagtcagagcattaccaactatttgaattggtatcaacaaaaaccagggagagcccctcacctccttatctatggtgcatccaccttacaaagtgggtcccatcaaggttcagtggcactggatctgggacagatttcactctcaccatcagcagtctgcaacctgaagattttgcaacttattactgtcaacagagtttcagtacgcggacgttcggccgaagggaccaaggtaggaaagtactaaacgaacctaggtggcgtgcaccaactctcgtcttctatccttccccg

SEQ ID NO: 599343 - DNA, 517 bp, Homo sapiens
  misc_feature: HIJSMM301C3KMW.11.1.A01.1.454.light.4.raw
cgagagataccacgaccggtgctcgatttagacgtctcatcaggggaggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgccccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccaggacccctggagcctcacgttggaagcagccgatccagcctgcggagcctgtgggcagggtcagcccaagggccaaccccactcgtcactcc

SEQ ID NO: 599344 - DNA, 503 bp, Homo sapiens
  misc_feature: HIJSMM301BEOZZ.21.22.B11.1.454.light.4.raw
  modified_base (461)..(461): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggngttcggcggagggaccaaactgaccgtcctaggtcagcccaa

SEQ ID NO: 599345 - DNA, 484 bp, Homo sapiens; identical to SEQ ID NO: 535400
  misc_feature: HIJSMM301CC8AB.46.26.C04.1.454.light.4.raw

SEQ ID NO: 599346 - DNA, 504 bp, Homo sapiens; identical to SEQ ID NO: 570463
  misc_feature: HIJSMM301CG06C.21.22.B11.1.454.light.4.raw

SEQ ID NO: 599347 - DNA, 496 bp, Homo sapiens; identical to SEQ ID NO: 537925
  misc_feature: HIJSMM301EBERX.22.14.B03.1.454.light.4.raw

SEQ ID NO: 599348 - DNA, 511 bp, Homo sapiens
  misc_feature: HIJSMM301BQFBK.43.67.G01.1.454.light.4.raw
tgtgagtagtcacgaccggtgctcgatttagagtatacatattgggtttggggacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggccggggaccgaccggtcggaaatacaaacgaactagtggctgcaccatctgtcttcatt

SEQ ID NO: 599349 - DNA, 504 bp, Homo sapiens; identical to SEQ ID NO: 540689
  misc_feature: HIJSMM301DWN7Z.21.38.D05.1.454.light.4.raw

SEQ ID NO: 599350 - DNA, 503 bp, Homo sapiens
  misc_feature: HIJSMM301DV0GK.3.4.A04.1.454.light.4.raw
agacgcactccacgaccggtgctcgatttagagtagtgatcagggcacgaccggtgctcgatttagagtagtgatcaggggtgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactctggggtcccagacagattcagcggcagtgggtcaggcactgatttcacattgaaaatcagcagggtggaggctgaggatgttggggtttattactgcatgcaaggtacacactggcctccgacgttcgccacggaccaaggtgaaatac

SEQ ID NO: 599351 - DNA, 497 bp, Homo sapiens; identical to SEQ ID NO: 535740
  misc_feature: HIJSMM301EJ32A.3.71.G05.1.454.light.4.raw

SEQ ID NO: 599352 - DNA, 487 bp, Homo sapiens
  misc_feature: HIJSMM301D6PBV.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctcactttcggcggaggaccaaggcggagatcagacgaactgtggctgcaccatctgtcttcta

SEQ ID NO: 599353 - DNA, 447 bp, Homo sapiens; identical to SEQ ID NO: 549542
  misc_feature: HIJSMM301BW2DJ.18.9.A09.1.454.light.4.raw

SEQ ID NO: 599354 - DNA, 494 bp, Homo sapiens; identical to SEQ ID NO: 534994
  misc_feature: HIJSMM301C4QGV.27.78.H01.1.454.light.4.raw

SEQ ID NO: 599355 - DNA, 505 bp, Homo sapiens; identical to SEQ ID NO: 536117
  misc_feature: HIJSMM301AGTD8.8.71.G05.1.454.light.4.raw

SEQ ID NO: 599356 - DNA, 485 bp, Homo sapiens; identical to SEQ ID NO: 536263
  misc_feature: HIJSMM301DY2KO.47.78.H01.1.454.light.4.raw

SEQ ID NO: 599357 - DNA, 507 bp, Homo sapiens
  misc_feature: HIJSMM301BQP9Q.48.25.C03.1.454.light.4.raw
agtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagccctcccaggctcctcatttatgatacatccaccagggccactggtgtcccagccaggttcactggcggtgggtctgggacagagttcactctcaccatcagcagcctgcagtctgaagattttacattttattactgtcagcagtatcgtaagtggactccgacgtttggccaagggaccaaggtggaagtcaaacgaactgtggctgcaccatctgtcttcatcttcccgcat

SEQ ID NO: 599358 - DNA, 547 bp, Homo sapiens
  misc_feature: HIJSMM301AGB9J.3.4.A04.1.454.light.4.raw
agacgcactccacgaccggtgctcgatttagagtagtgatcagggtgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcgagggtgggagggcgtgagggatggtttgggggtttagtttacttacgtcatgtcgaaggtaacgaccaactcggccgtccgaccgtcggccgtccgggaccgaaccggtaggaagtaacgaaacgaaactaacgtagtgtacgctaccgactactcgtcttccgtta

SEQ ID NO: 599359 - DNA, 493 bp, Homo sapiens; identical to SEQ ID NO: 540127
  misc_feature: HIJSMM301DWYJG.10.17.B06.1.454.light.4.raw

SEQ ID NO: 599360 - DNA, 482 bp, Homo sapiens; identical to SEQ ID NO: 560945
  misc_feature: HIJSMM301DPA5B.13.8.A08.1.454.light.4.raw

SEQ ID NO: 599361 - DNA, 492 bp, Homo sapiens
  misc_feature: HIJSMM301D68L2.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcagcagtataataactggttcctgctcacgtttcggcgggggaccaaggtggagatcaaacgaactgtggctgcacatctgt

SEQ ID NO: 599362 - DNA, 481 bp, Homo sapiens; identical to SEQ ID NO: 537885
  misc_feature: HIJSMM301E09TY.11.17.B06.1.454.light.4.raw

SEQ ID NO: 599363 - DNA, 485 bp, Homo sapiens; identical to SEQ ID NO: 536723
  misc_feature: HIJSMM301AIHRU.5.40.D07.1.454.light.4.raw

SEQ ID NO: 599364 - DNA, 453 bp, Homo sapiens; identical to SEQ ID NO: 536654
  misc_feature: HIJSMM301EMKDF.19.86.H09.1.454.light.4.raw

SEQ ID NO: 599365 - DNA, 490 bp, Homo sapiens
  misc_feature: HIJSMM301DMOGF.49.20.B09.1.454.light.4.raw
agtcgagagacacgaccggtgctcgatttagtgtagtgtgaagggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacaatatgcttactggtaccagcagaggccaggccaggcccctgtcttggtgatttataaagactttgagaggccctcagggacccctgagcgattctctggctccagctcagggacaacagtcaccttgaccatcagtggagtccggccagaggacgaggctgactattactgtcagtccgcagacagcagtggcagttatgtcgtattcggcggagggactacgctgaccgtcctaggtcagcccaaggctgccccctcggtcactctcg

SEQ ID NO: 599366 - DNA, 507 bp, Homo sapiens
  misc_feature: HIJSMM301DNCQX.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggaggaccaagctgaccgtccaggtcagcccaagctgccccctcggtcactctcgtt

SEQ ID NO: 599367 - DNA, 515 bp, Homo sapiens
  misc_feature: HIJSMM301CEKTL.15.25.C03.1.454.light.4.raw
  modified_base (509)..(509): a, c, t, g, unknown or other
tctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactagaaaatacagcagagtggaggcgtgagggacgttggggtttagttacttgcatgcaacggtactactaaaccccgaactcacctcggtccgacggacgacgcctcggagataaactaacgtagtggcgtcgnaccact

SEQ ID NO: 599368 - DNA, 489 bp, Homo sapiens; identical to SEQ ID NO: 535139
  misc_feature: HIJSMM301BZNPR.14.55.E11.1.454.light.4.raw

SEQ ID NO: 599369 - DNA, 463 bp, Homo sapiens; identical to SEQ ID NO: 535062
  misc_feature: HIJSMM301C6RUF.11.73.G07.1.454.light.4.raw

SEQ ID NO: 599370 - DNA, 445 bp, Homo sapiens; identical to SEQ ID NO: 537719
  misc_feature: HIJSMM301BL9KV.47.85.H08.1.454.light.4.raw

SEQ ID NO: 599371 - DNA, 485 bp, Homo sapiens
  misc_feature: HIJSMM301DVZS7.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggtctaatcgggcctccggggtccctgacaggttcagtggcagtggatcaggcacagattttacactgaaaatcagcagagtggaggctgaggatggttgggcttctattattgcatgcaagctctacaagtcccgctcactttcggcggagggaccaaggtggagatcaaacgaa

SEQ ID NO: 599372 - DNA, 508 bp, Homo sapiens; identical to SEQ ID NO: 541017
  misc_feature: HIJSMM301B5Z9L.17.33.C11.1.454.light.4.raw

SEQ ID NO: 599373 - DNA, 486 bp, Homo sapiens; identical to SEQ ID NO: 537310
  misc_feature: HIJSMM301EBODI.15.28.C06.1.454.light.4.raw

SEQ ID NO: 599374 - DNA, 493 bp, Homo sapiens
  misc_feature: HIJSMM301BZ882.15.3.A03.1.454.light.4.raw
tctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtatcagaaaaaaccaggacagcctcctaagctgctcatttactgggcatctacccgggaatccggggtccctgaccgattcagtggcagcgggtctggcacagatttcactctcaccatcagcagcctgcaggctgaagatgtggcagtttattactgtcagcaatatgaaagttattccttttactttcggccctgggaccaaagtggatatcaaacgaactgtggctgcaccat

SEQ ID NO: 599375 - DNA, 511 bp, Homo sapiens
  misc_feature: HIJSMM301A4IFW.16.46.E02.1.454.light.4.raw
tgtactactccacgaccggtgctcgatttagactcatctacagggaaagggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtctttcggaactgggaccaaggtcaccgtcctaggtcagcccaaggccaacccactgtcactctcg

SEQ ID NO: 599376 - DNA, 491 bp, Homo sapiens; identical to SEQ ID NO: 582338
  misc_feature: HIJSMM301AN4N2.17.21.B10.1.454.light.4.raw

SEQ ID NO: 599377 - DNA, 495 bp, Homo sapiens; identical to SEQ ID NO: 536931
  misc_feature: HIJSMM301BR1J9.10.33.C11.1.454.light.4.raw

SEQ ID NO: 599378 - DNA, 491 bp, Homo sapiens; identical to SEQ ID NO: 535294
  misc_feature: HIJSMM301DGLN7.16.68.G02.1.454.light.4.raw

SEQ ID NO: 599379 - DNA, 503 bp, Homo sapiens; identical to SEQ ID NO: 552088
  misc_feature: HIJSMM301BJ2CC.2.35.D02.1.454.light.4.raw

SEQ ID NO: 599380 - DNA, 512 bp, Homo sapiens; identical to SEQ ID NO: 552150
  misc_feature: HIJSMM301DKP4J.17.33.C11.1.454.light.4.raw

SEQ ID NO: 599381 - DNA, 488 bp, Homo sapiens
  misc_feature: HIJSMM301CLYTO.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgccaggctgaagatgtggcagtttattattgtcaacaatattattatacttcgtggacgttcggccaagggaccaaggtggatatacagacgaa

SEQ ID NO: 599382 - DNA, 446 bp, Homo sapiens; identical to SEQ ID NO: 538372
  misc_feature: HIJSMM301EJWD3.18.9.A09.1.454.light.4.raw

SEQ ID NO: 599383 - DNA, 484 bp, Homo sapiens; identical to SEQ ID NO: 535211
  misc_feature: HIJSMM301CGKDK.47.46.E02.1.454.light.4.raw

SEQ ID NO: 599384 - DNA, 510 bp, Homo sapiens; identical to SEQ ID NO: 538614
  misc_feature: HIJSMM301BO383.19.59.F04.1.454.light.4.raw

SEQ ID NO: 599385 - DNA, 356 bp, Homo sapiens
  misc_feature: HIJSMM301D2NNO.40.9.A09.1.454.light.4.raw
tctagcgactcacgaccggtgctcgatttagcgagacgcgcagggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaaacctcctaagttgctcttttactgggcgtcttcccgggagtccggggtccctgaccgattcagtgccagcgggtctgggacagacttcactctcacca

SEQ ID NO: 599386 - DNA, 487 bp, Homo sapiens; identical to SEQ ID NO: 561054
  misc_feature: HIJSMM301BE4NY.15.49.E05.1.454.light.4.raw

SEQ ID NO: 599387 - DNA, 491 bp, Homo sapiens; identical to SEQ ID NO: 565902
  misc_feature: HIJSMM301CM704.22.65.F10.1.454.light.4.raw

SEQ ID NO: 599388 - DNA, 491 bp, Homo sapiens; identical to SEQ ID NO: 535176
  misc_feature: HIJSMM301DVCDO.13.39.D06.1.454.light.4.raw

SEQ ID NO: 599389 - DNA, 502 bp, Homo sapiens
  misc_feature: HIJSMM301CPKRI.51.55.E11.1.454.light.4.raw
cgatcgtatacacgaccggtgctcgatttagcactcgcacgttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcatatacaatcaataacaattgggtgttcggcggaggaccaaactgaccgtcctaggtcagcccaaggctgccccct

SEQ ID NO: 599390 - DNA, 495 bp, Homo sapiens; identical to SEQ ID NO: 535007
  misc_feature: HIJSMM301DH4QW.22.5.A05.1.454.light.4.raw

SEQ ID NO: 599391 - DNA, 491 bp, Homo sapiens
  misc_feature: HIJSMM301D5IJI.41.57.F02.1.454.light.4.raw
tctatactatcacgaccggtgctcgatttagctcgatatagttgggtttggggtccaaacagagcttcagcaagcatagtggggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacagctacaatgttggcaacgaaggagcagcttggctgcagcagtaccagggccaccctcccaaattgctatcatacaggaagaacaaccgcccctcggggatctccgagagattctctgcatcaacgtcaggaaacatagcctcctgaccattactggactccagcctgaggacgaggctgactattactgctcagcatgggacagcagcctcaatggtttgggtggttcggcggacgggaccaagctgaccgtcctaggtcacgg

SEQ ID NO: 599392 - DNA, 491 bp, Homo sapiens; identical to SEQ ID NO: 536211
  misc_feature: HIJSMM301BTGBA.16.53.E09.1.454.light.4.raw

SEQ ID NO: 599393 - DNA, 486 bp, Homo sapiens
  misc_feature: HIJSMM301A65MM.19.71.G05.1.454.light.4.raw
  modified_base (408)..(408): a, c, t, g, unknown or other
tactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctctggggcgagcgggccaccgatcgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgnggcagtttattattgtcaacaatattattatacttcgtggacgttcggccaagggaccaaaggtggatatcagacgaa

SEQ ID NO: 599394 - DNA, 496 bp, Homo sapiens; identical to SEQ ID NO: 535109
  misc_feature: HIJSMM301AJC5R.16.78.H01.1.454.light.4.raw

SEQ ID NO: 599395 - DNA, 518 bp, Homo sapiens
  misc_feature: HIJSMM301EYZGE.9.2.A02.1.454.light.4.raw
tgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggtggctctaatcatgtctcctggtactataacagtccaggcaaagcccccaaactcataatttatgatgtctttagacggccctcagggatttcttctcggttgtctggctccaagtctgggaacacggcctccctgaccatctctggacttcagcctgaggacgagggtgattacttctgcagttcagattcagaaacttcccctcgttgggtgttcggcggagggaccatgctgaccgtcctgagtcagcccaaggctgccccctcggtcactctcgttcccaccct

SEQ ID NO: 599396 - DNA, 527 bp, Homo sapiens
  misc_feature: HIJSMM301BWFAF.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggctagtttattactgtcaactagttttcgtcgggtcgttcggtccgaacgggaccgtaacgggtaggaaagtacaaaaccgaactacgtggtcgtcggcaccatcttgtcttctatccttccccg

SEQ ID NO: 599397 - DNA, 485 bp, Homo sapiens; identical to SEQ ID NO: 536040
  misc_feature: HIJSMM301D9QBE.15.1.A01.1.454.light.4.raw

SEQ ID NO: 599398 - DNA, 518 bp, Homo sapiens; identical to SEQ ID NO: 579925
  misc_feature: HIJSMM301D272W.14.78.H01.1.454.light.4.raw

SEQ ID NO: 599399 - DNA, 444 bp, Homo sapiens; identical to SEQ ID NO: 535192
  misc_feature: HIJSMM301BW4K6.5.9.A09.1.454.light.4.raw

SEQ ID NO: 599400 - DNA, 493 bp, Homo sapiens; identical to SEQ ID NO: 537422
  misc_feature: HIJSMM301A00G3.9.34.D01.1.454.light.4.raw

SEQ ID NO: 599401 - DNA, 509 bp, Homo sapiens; identical to SEQ ID NO: 588268
  misc_feature: HIJSMM301BVFKH.8.34.D01.1.454.light.4.raw

SEQ ID NO: 599402 - DNA, 487 bp, Homo sapiens; identical to SEQ ID NO: 537079
  misc_feature: HIJSMM301EWO8D.14.55.E11.1.454.light.4.raw

SEQ ID NO: 599403 - DNA, 458 bp, Homo sapiens
  misc_feature: HIJSMM301AI36E.41.57.F02.1.454.light.4.raw
tctatactatcacgaccggtgctcgatttagctcgatatagttgggtttggggtccaaacagagcttcggcaagcatagtgggaatctgcaccatgccctgggctctgctcctcctgaccctcctcactcacctgcactgggaacagctacaatgttggcaacgaaggagcagcttggctgcagcagtaccagggccaccctcccaaattgctatcatacaggaagaacaaccgcccctcggggatctccgagagattctctgcatcaacgtcaggaaacatagcctccctgaccattactggactccagcctgaggacgaggctgactattactgctcagcatgggacagcagcctcaatgtttgggtgttcggcggagggaccaagctgaccgtcctaggtcagcccaaggctgccccctcggtcactctgttccccgccctcctcatagtataga

SEQ ID NO: 599404 - DNA, 486 bp, Homo sapiens; identical to SEQ ID NO: 535043
  misc_feature: HIJSMM301BW298.46.35.D02.1.454.light.4.raw

SEQ ID NO: 599405 - DNA, 518 bp, Homo sapiens; identical to SEQ ID NO: 539372
  misc_feature: HIJSMM301BDONW.7.86.H09.1.454.light.4.raw

SEQ ID NO: 599406 - DNA, 498 bp, Homo sapiens
  misc_feature: HIJSMM301BCL38.16.10.A10.1.454.light.4.raw
tgtactactccacgaccggtgctcgatttagcgtcgatctcagggggtgggtccgaggaggcagaactctgggtgtctcaccatggcctggatccctctacttctcccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagaggccctcagggatccctgggcgattctctggctccagctcagggacgacagtcacgttgaccatcggtggagtccaggcagaagacgagggtgactattactgtcagtctgcaaacaccactgcagcggtgttcggcggagggaccaagctgaccgtcctgcgtcacgcccaaggctcgccccctcggtcactctcgtcccta

SEQ ID NO: 599407 - DNA, 484 bp, Homo sapiens
  misc_feature: HIJSMM301B30G4.5.34.D01.1.454.light.4.raw
atcagacacgcacgaccggtgctcgatttagatcgtctgtgttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccctccgaccttcggccagggacacgactggagattaaacgaactagtggctgcaccta

SEQ ID NO: 599408 - DNA, 444 bp, Homo sapiens; identical to SEQ ID NO: 535192
  misc_feature: HIJSMM301CZMHP.5.9.A09.1.454.light.4.raw

SEQ ID NO: 599409 - DNA, 511 bp, Homo sapiens
  misc_feature: HIJSMM301A6EWZ.13.3.A03.1.454.light.4.raw
tcacgtactacacgaccggtgctcgatttagagagcgtcacaggggggggtcgacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaactcattatttacggggtcaataagcggccctcagggctttctgatcgcttctctggctccaagtctggcaacacggcctccctgacaatctctggactccaggccgaggacgaggctgatttttactgttgttcatatgcaggaaggagtgattatgtctttggaagtgggaccaaggtcaccgtccttggtcagcccaaggccaaccccactgtcactctgttccca

SEQ ID NO: 599410 - DNA, 494 bp, Homo sapiens; identical to SEQ ID NO: 541035
  misc_feature: HIJSMM301C17NO.26.12.B01.1.454.light.4.raw

SEQ ID NO: 599411 - DNA, 511 bp, Homo sapiens
  misc_feature: HIJSMM301BG2IW.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcgccgggggaccgaccgtggaaagtcaaacgaactagtggctgcaccatctgtcttt

SEQ ID NO: 599412 - DNA, 499 bp, Homo sapiens
  misc_feature: HIJSMM301CB46V.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggcctgccccctcggtccactctcgttcccgccctcctcgagtgcgtct

SEQ ID NO: 599413 - DNA, 494 bp, Homo sapiens; identical to SEQ ID NO: 534992
  misc_feature: HIJSMM301C33QG.9.1.A01.1.454.light.4.raw

SEQ ID NO: 599414 - DNA, 489 bp, Homo sapiens
  misc_feature: HIJSMM301DPYIM.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgcaacagtatcatcatcattgtaatttcggtggagggaccaaggtgaggtcaaacgactagtggctgcaccatctgtcttcatt

SEQ ID NO: 599415 - DNA, 488 bp, Homo sapiens; identical to SEQ ID NO: 535725
  misc_feature: HIJSMM301B4RA1.12.88.H11.1.454.light.4.raw

SEQ ID NO: 599416 - DNA, 493 bp, Homo sapiens; identical to SEQ ID NO: 547772
  misc_feature: HIJSMM301ASKEP.47.64.F09.1.454.light.4.raw

SEQ ID NO: 599417 - DNA, 503 bp, Homo sapiens; identical to SEQ ID NO: 584633
  misc_feature: HIJSMM301EGWYL.43.38.D05.1.454.light.4.raw

SEQ ID NO: 599418 - DNA, 510 bp, Homo sapiens; identical to SEQ ID NO: 542037
  misc_feature: HIJSMM301DMIFL.4.57.F02.1.454.light.4.raw

SEQ ID NO: 599419 - DNA, 499 bp, Homo sapiens
  misc_feature: HIJSMM301AKWKK.12.87.H10.1.454.light.4.raw
atacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcattgggggaaaagtttgctttctggtatcagcagaagccaggccagtcccctgtcttggtcatctataaggatagcaggcggccctcagggattcctgagcgattctccggctccaactccggcaacacagccactctgaccatcagcgggacccaggctctcgatgaggctgactattactgccaggcgtgggacagctccacttcccgttatgtcttcggaggtgggaccatggtcaccgtcctaggtcagcccaacgaccaacccacctcgt

SEQ ID NO: 599420 - DNA, 485 bp, Homo sapiens; identical to SEQ ID NO: 536075
  misc_feature: HIJSMM301EBVPS.17.21.B10.1.454.light.4.raw

SEQ ID NO: 599421 - DNA, 490 bp, Homo sapiens; identical to SEQ ID NO: 538714
  misc_feature: HIJSMM301C8RAG.11.12.B01.1.454.light.4.raw

SEQ ID NO: 599422 - DNA, 484 bp, Homo sapiens; identical to SEQ ID NO: 540581
  misc_feature: HIJSMM301BHV1P.3.88.H11.1.454.light.4.raw

SEQ ID NO: 599423 - DNA, 492 bp, Homo sapiens
  misc_feature: HIJSMM301B7COI.52.43.D10.1.454.light.4.raw
cgcagtacgacacgaccggtgctcgatttagactagcagtaagggggaggaactgctcagttaggacccagacggaaccatggaagccccagcgcagcttctcttcctcctgctactctggctcccagattctactgaagaaatagtgatgacgcagtctccagccaccctgtctgtgtctccaggggaagcagtcaccctctcctgcagggccagtcagactgttaacaccaacttagcctggtaccagcacaaacctggccgggctcccaggctcctcatctatggtgcatccaccagggccactggtgtcccagccaggttcagtggcagtgggtctgggacagagttcactctcaccatcagcagcctgcagtctgaagattttgctagtttattactgtcagcagtatcataactggtcctcttcactttcggccctgggaccaaggtggatatcaaacgaactgtggctgcaccatctgtcttcta

SEQ ID NO: 599424 - DNA, 505 bp, Homo sapiens; identical to SEQ ID NO: 550891
  misc_feature: HIJSMM301EHJUI.3.53.E09.1.454.light.4.raw

SEQ ID NO: 599425 - DNA, 487 bp, Homo sapiens; identical to SEQ ID NO: 535069
  misc_feature: HIJSMM301E0BBQ.26.23.C01.1.454.light.4.raw

SEQ ID NO: 599426 - DNA, 497 bp, Homo sapiens; identical to SEQ ID NO: 535740
  misc_feature: HIJSMM301BHFH3.3.71.G05.1.454.light.4.raw

SEQ ID NO: 599427 - DNA, 448 bp, Homo sapiens
  misc_feature: HIJSMM301AHMMK.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctcccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccaccctcctccatactcgta

SEQ ID NO: 599428 - DNA, 490 bp, Homo sapiens
  misc_feature: HIJSMM301CZK5R.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcagtgggtcaggcgctgatttcacactgagaatcagcagggtggaggctgaagatgtcggggtttattactgcatgcagggtacagtgtggccttcgctcgcattcggcggaggggaccaaggtggaggatcaaacgaa

SEQ ID NO: 599429 - DNA, 511 bp, Homo sapiens; identical to SEQ ID NO: 546571
  misc_feature: HIJSMM301DI5L9.17.33.C11.1.454.light.4.raw

SEQ ID NO: 599430 - DNA, 492 bp, Homo sapiens
  misc_feature: HIJSMM301ER1HU.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcactggacttttggccagggaccaagctggagatcaaacgaactgtggctgcaccatctgtctt

SEQ ID NO: 599431 - DNA, 491 bp, Homo sapiens; identical to SEQ ID NO: 585179
  misc_feature: HIJSMM301B55Z9.15.3.A03.1.454.light.4.raw

SEQ ID NO: 599432 - DNA, 493 bp, Homo sapiens
  misc_feature: HIJSMM301CM6IZ.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaaactgtggctgcacccatctgtcttcatt

SEQ ID NO: 599433 - DNA, 508 bp, Homo sapiens
  misc_feature: HIJSMM301C8K8H.40.62.F07.1.454.light.4.raw
tctagcgactcacgaccggtgctcgatttagtagtcgcataaagggaaagggggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttattactgtctacaagattataattaccctcggacgttcggtccacggggaccgaacggtagggagtgttcaagacgaacctagtggcgtggtcaccaactctgtcttt

SEQ ID NO: 599434 - DNA, 493 bp, Homo sapiens; identical to SEQ ID NO: 546502
  misc_feature: HIJSMM301AWTAE.11.71.G05.1.454.light.4.raw

SEQ ID NO: 599435 - DNA, 494 bp, Homo sapiens; identical to SEQ ID NO: 543242
  misc_feature: HIJSMM301DN0T5.27.78.H01.1.454.light.4.raw
  modified_base (462)..(462): a, c, t, g, unknown or other

SEQ ID NO: 599436 - DNA, 490 bp, Homo sapiens
  misc_feature: HIJSMM301EI8Z6.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctacagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcaccatctgt

SEQ ID NO: 599437 - DNA, 487 bp, Homo sapiens; identical to SEQ ID NO: 558003
  misc_feature: HIJSMM301A9AK4.47.70.G04.1.454.light.4.raw

SEQ ID NO: 599438 - DNA, 515 bp, Homo sapiens
  misc_feature: HIJSMM301EQTAS.51.27.C05.1.454.light.4.raw
cgatcgtatacacgaccggtgctcgatttagacgcgatcgaagggtttgggcacgaccgtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaggcaaagcccccaaactcatgatttatgatgtcagtgatcggccctcaggggtttcgaatcgcttctctggctccaagtccggcaacacggcctccctgaccatctctgggctccaggccgaggacgaggctgattattactgcacctcatatacaagcagcaacaattgggtgttcggcggagggaccaagctgaccgtcc

SEQ ID NO: 599439 - DNA, 519 bp, Homo sapiens; identical to SEQ ID NO: 543692
  misc_feature: HIJSMM301D9ERC.41.19.B08.1.454.light.4.raw

SEQ ID NO: 599440 - DNA, 491 bp, Homo sapiens; identical to SEQ ID NO: 535176
  misc_feature: HIJSMM301D3RHW.13.39.D06.1.454.light.4.raw

SEQ ID NO: 599441 - DNA, 491 bp, Homo sapiens; identical to SEQ ID NO: 535176
  misc_feature: HIJSMM301ALDDR.13.39.D06.1.454.light.4.raw

SEQ ID NO: 599442 - DNA, 513 bp, Homo sapiens; identical to SEQ ID NO: 543780
  misc_feature: HIJSMM301CZLP4.17.33.C11.1.454.light.4.raw

SEQ ID NO: 599443 - DNA, 516 bp, Homo sapiens
  misc_feature: HIJSMM301DPQ8Y.40.12.B01.1.454.light.4.raw
tctagcgactcacgaccggtgctcgatttagtagtgtagattccgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggcaacaattgggtcttcggcggagggaccaagctgaccgtcctaggtcagccccaaggctgccccctcggtcactctgttcccta

SEQ ID NO: 599444 - DNA, 502 bp, Homo sapiens
  misc_feature: HIJSMM301AU2KG.17.28.C06.1.454.light.4.raw
cgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggacacggctgaccgtcctaagtcagcccaaggct

SEQ ID NO: 599445 - DNA, 518 bp, Homo sapiens
  misc_feature: HIJSMM301DD9P8.10.28.C06.1.454.light.4.raw
catagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctcaggggtttctgatcgcttctttgcctccaagtctggcaacacggcctccctgaccatctctggctccagactgaggacgaggctgattattactgtcagctcacatacaagcggcagcggttgggtggttcggcgggggaccgacactgaccgtcctaggtcagccaaggctcgcccctcggtcactctgttccccg

SEQ ID NO: 599446 - DNA, 510 bp, Homo sapiens
  misc_feature: HIJSMM301AK1FP.12.53.E09.1.454.light.4.raw
atacgacgtacacgaccggtgctcgatttagagagagtgtgttgggtttgggggctggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgggtcagcccaaggctgccccctc

SEQ ID NO: 599447 - DNA, 512 bp, Homo sapiens; identical to SEQ ID NO: 562621
  misc_feature: HIJSMM301BPFMV.7.34.D01.1.454.light.4.raw

SEQ ID NO: 599448 - DNA, 495 bp, Homo sapiens; identical to SEQ ID NO: 569769
  misc_feature: HIJSMM301DMCEF.9.1.A01.1.454.light.4.raw

SEQ ID NO: 599449 - DNA, 484 bp, Homo sapiens; identical to SEQ ID NO: 535400
  misc_feature: HIJSMM301CSKZB.46.26.C04.1.454.light.4.raw

SEQ ID NO: 599450 - DNA, 495 bp, Homo sapiens
  misc_feature: HIJSMM301EXEAB.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccaaagtaggacgatacaagcgaactagtggctgcaccatctgtt

SEQ ID NO: 599451 - DNA, 493 bp, Homo sapiens; identical to SEQ ID NO: 536032
  misc_feature: HIJSMM301C5OE4.22.57.F02.1.454.light.4.raw

SEQ ID NO: 599452 - DNA, 506 bp, Homo sapiens
  misc_feature: HIJSMM301AKHY4.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggaggatcaaacgaactgtggctgcaccatctgtcttcatcttcccgccat

SEQ ID NO: 599453 - DNA, 507 bp, Homo sapiens
  misc_feature: HIJSMM301EV32U.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaacgcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtcctgggtcagcccaaggctcgccccctcggtccta

SEQ ID NO: 599454 - DNA, 484 bp, Homo sapiens; identical to SEQ ID NO: 535211
  misc_feature: HIJSMM301BXO02.47.46.E02.1.454.light.4.raw

SEQ ID NO: 599455 - DNA, 514 bp, Homo sapiens
  misc_feature: HIJSMM301DV3IE.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagccgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactctgttccccg

SEQ ID NO: 599456 - DNA, 495 bp, Homo sapiens; identical to SEQ ID NO: 568500
  misc_feature: HIJSMM301BO0D7.5.12.B01.1.454.light.4.raw

SEQ ID NO: 599457 - DNA, 481 bp, Homo sapiens; identical to SEQ ID NO: 572333
  misc_feature: HIJSMM301DLM57.17.26.C04.1.454.light.4.raw

SEQ ID NO: 599458 - DNA, 498 bp, Homo sapiens
  misc_feature: HIJSMM301DSM8B.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggccgaagggaccgaacggttaggaaagtactaaaacgaaactagtggcgtcgcacctaa

SEQ ID NO: 599459 - DNA, 503 bp, Homo sapiens; identical to SEQ ID NO: 543109
  misc_feature: HIJSMM301EIAZ8.19.78.H01.1.454.light.4.raw

SEQ ID NO: 599460 - DNA, 498 bp, Homo sapiens
  misc_feature: HIJSMM301D00RU.40.36.D03.1.454.light.4.raw
tctagcgactcacgaccggtgctcgatttagctgcgtcacgatctctcttgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttatactgtcaacaatattattatactccgccgacgttcggccggggaccgaacgtggaaatacaaacgaactgtggctgca

SEQ ID NO: 599461 - DNA, 461 bp, Homo sapiens; identical to SEQ ID NO: 587016
  misc_feature: HIJSMM301AMOK8.43.66.F11.1.454.light.4.raw

SEQ ID NO: 599462 - DNA, 481 bp, Homo sapiens; identical to SEQ ID NO: 535993
  misc_feature: HIJSMM301B03SA.21.25.C03.1.454.light.4.raw

SEQ ID NO: 599463 - DNA, 486 bp, Homo sapiens
  misc_feature: HIJSMM301CEKSK.13.71.G05.1.454.light.4.raw
tcacgtactacacgaccggtgctcgatttagtgtcgtcgcaagagagaggggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagataccaagcggccctcagggatccctgagcgattctctggctccaactctgggaacacagccactctgaccatcagcgggacccaggctgtggatgaggctgactattactgtcaggcgtgggacagcagcactgcctccttcggaactcgggaccgaacggtcacccgtcctacggtcgacgcccaacggacccaa

SEQ ID NO: 599464 - DNA, 492 bp, Homo sapiens; identical to SEQ ID NO: 537666
  misc_feature: HIJSMM301DVD65.43.33.C11.1.454.light.4.raw

SEQ ID NO: 599465 - DNA, 477 bp, Homo sapiens; identical to SEQ ID NO: 559307
  misc_feature: HIJSMM301AF0C6.43.13.B02.1.454.light.4.raw

SEQ ID NO: 599466 - DNA, 501 bp, Homo sapiens
  misc_feature: HIJSMM301B5ONV.51.58.F03.1.454.light.4.raw
cgatcgtatacacgaccggtgctcgatttagtctgatcgagaagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgctgctcacatgcaggcagcatcggtgtgctattcggcggagggaccaagctgaccgtcctaggtcagcccaaggctgccccccg

SEQ ID NO: 599467 - DNA, 493 bp, Homo sapiens
  misc_feature: HIJSMM301AW4JN.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagcccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtctaggtcagcccaaggccaacccc

SEQ ID NO: 599468 - DNA, 441 bp, Homo sapiens; identical to SEQ ID NO: 534971
  misc_feature: HIJSMM301EVFGA.11.3.A03.1.454.light.4.raw

SEQ ID NO: 599469 - DNA, 509 bp, Homo sapiens
  misc_feature: HIJSMM301CWAK2.9.71.G05.1.454.light.4.raw
tgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaacgcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttccttctttcaagattattcggcgggagggaccaggctgaccgtcctgagtcagcccaaggctcgccccccg

SEQ ID NO: 599470 - DNA, 487 bp, Homo sapiens
  misc_feature: HIJSMM301C5A4G.49.23.C01.1.454.light.4.raw
agtcgagagacacgaccggtgctcgatttagtacacgtgattagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagaatattaataagtggttggcctggtatcagcagataccagggaaagcccctaaactcctgatctatgaggcgtctagtttagaaagtggggtcccttcaaggttcagcggcagtggatctgggacagaattcactctcaccatcaacagcctgcagcctgatgattttgcaacttattactgccaacactaataatcattattctccggccactttcggccctggaccaggctagatatcggacgaactgtggctgcaccat

SEQ ID NO: 599471 - DNA, 499 bp, Homo sapiens; identical to SEQ ID NO: 536187
  misc_feature: HIJSMM301D5JBJ.11.67.G01.1.454.light.4.raw

SEQ ID NO: 599472 - DNA, 488 bp, Homo sapiens; identical to SEQ ID NO: 584551
  misc_feature: HIJSMM301CSUAD.11.28.C06.1.454.light.4.raw

SEQ ID NO: 599473 - DNA, 516 bp, Homo sapiens
  misc_feature: HIJSMM301EK30D.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcgggacccagaccctggagcctcagttggaagcagccgatccagcctgcggagcctgtgggcaggtcagcccaaggccaacccactgtcactctccg

SEQ ID NO: 599474 - DNA, 518 bp, Homo sapiens
  misc_feature: HIJSMM301B6UOM.27.78.H01.1.454.light.4.raw
  modified_base (505)..(505): a, c, t, g, unknown or other
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtacaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctggggacacattttcaccctcaccatcaatagccctggaagctgaagatgctgcaacttatttactgtcatcaggatactactttacctctaagtagatcacccttcgccgaacggaacgacgactaggnggaattaaaaccg

SEQ ID NO: 599475 - DNA, 502 bp, Homo sapiens; identical to SEQ ID NO: 547421
  misc_feature: HIJSMM301BH0ZJ.51.5.A05.1.454.light.4.raw

SEQ ID NO: 599476 - DNA, 509 bp, Homo sapiens
  misc_feature: HIJSMM301B6PWX.7.87.H10.1.454.light.4.raw
  modified_base (380)..(380): a, c, t, g, unknown or other
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggancctgaagattttgcagtatattactgtcagcaatatggtacttcacccggacgtcgcacggacgacggtaggagtacaacgaactagtggcgtgtcaccactctcgtcttctatcttcccgtccactct

SEQ ID NO: 599477 - DNA, 505 bp, Homo sapiens
  misc_feature: HIJSMM301CQ1TU.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactacttacctcaatgatcaaccttcggcccaagggacacgacctggagattaaaacg

SEQ ID NO: 599478 - DNA, 494 bp, Homo sapiens; identical to SEQ ID NO: 538230
  misc_feature: HIJSMM301DP2SZ.11.71.G05.1.454.light.4.raw

SEQ ID NO: 599479 - DNA, 485 bp, Homo sapiens
  misc_feature: HIJSMM301AQTI8.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgagattttgcaacttattactgtctacaagattacacttaccctgggacgttcggccgaagggaccgaaggtaggaaagtacaaacgaactagtggctgcacca

SEQ ID NO: 599480 - DNA, 493 bp, Homo sapiens
  misc_feature: HIJSMM301CTNJO.40.81.H04.1.454.light.4.raw
tctagcgactcacgaccggtgctcgatttagtagtgtagattcgcgggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagattttacactgaaaatcagcagggtggaggcagaagatgttgggatttattactgcatgcaacctctacaaactgtgtggacggtcggccaagggaccaaggtggaaatcaaagcgaactgtggctgcacc

SEQ ID NO: 599481 - DNA, 473 bp, Homo sapiens; identical to SEQ ID NO: 535262
  misc_feature: HIJSMM301BR4IX.8.67.G01.1.454.light.4.raw

SEQ ID NO: 599482 - DNA, 494 bp, Homo sapiens; identical to SEQ ID NO: 534994
  misc_feature: HIJSMM301AZT71.27.78.H01.1.454.light.4.raw

SEQ ID NO: 599483 - DNA, 497 bp, Homo sapiens
  misc_feature: HIJSMM301AWSDE.12.38.D05.1.454.light.4.raw
atacgacgtacacgaccggtgctcgatttagtatctgatagttgggtttgggggaactgctcagttaggacccagacggaaccatggaagccccagcgcagcttctcttcctcctgctactctggctcccagattcctctggagaagttgtgatgacgcagtctccagccaccctgtctgcgtctccaggggaaagagtcaccctctcatgcagggccagtgagattgttaccaccaacttagcctggtaccaacagaaacctggccagcctcccaggctcctcatttatggtgcatccacaagggccgctggtgtcccagccaggttcagtggcagtggatctgcgacagagttcactctcaccgtcagcagcctgcagtctgaagattttgcagtttattacttgtcagcagtatgagaagtggttcaagactttcggcggagggaccaaggtggagagtcaaacgaactgtggctgcaccatctgtcttcactt

SEQ ID NO: 599484 - DNA, 504 bp, Homo sapiens; identical to SEQ ID NO: 539032
  misc_feature: HIJSMM301CEW0A.19.67.G01.1.454.light.4.raw

SEQ ID NO: 599485 - DNA, 500 bp, Homo sapiens
  misc_feature: HIJSMM301BVHWT.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatccctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcgggcgttcggccgaaggggccaaggtggaaatcaaacgaactgtgctgcacatctgtcttcatctcccg

SEQ ID NO: 599486 - DNA, 470 bp, Homo sapiens
  misc_feature: HIJSMM301BTPT9.49.27.C05.1.454.light.4.raw
agtcgagagacacgaccggtgctcgatttagacgcgatcgaagggtttggggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcggggggaccgaaggtggagatccagcgaa

SEQ ID NO: 599487 - DNA, 518 bp, Homo sapiens
  misc_feature: HIJSMM301DG97Q.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccgaacgggaccgaacggtaggaagtacgaaacgaactagtggcgtgcgaccatctgtcttctatcttcccgtccact

SEQ ID NO: 599488 - DNA, 496 bp, Homo sapiens
  misc_feature: HIJSMM301CZVMZ.4.23.C01.1.454.light.4.raw
agcactgtagcacgaccggtgctcgatttagtacacgtgattagggattgggggaggaactgctcagttaggacccagacggaaccatggaagccccagcgcagcttctcttcctcctgctactctggctcccagataccactggagaaataatattgacgcagtctccagccaccctgtctgtgtctccaggggaaagagccaccctctcctgcagggccagtcagagtgttagcagcaacttagcctggtaccagcagaagcctggccagactcccaggctcctcatctttggtgcattcaccagggccactgatatcccaaccaggttcagcggcagtgggtctgggacagagttcactctcaccatcagcaacctgcagtctgaagattctgcagtttattattgtcaccagtattatagttggcctccgtggacgttcggccaagggaccaaggtggaaatcaaacgaactgtggctgcaccatctgtctt

SEQ ID NO: 599489 - DNA, 500 bp, Homo sapiens
  misc_feature: HIJSMM301AH0R7.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccactgtgatcttcggcggggggaccaagctgaccgtcctaggtcagcccaaggct

SEQ ID NO: 599490 - DNA, 505 bp, Homo sapiens; identical to SEQ ID NO: 536232
  misc_feature: HIJSMM301EI9J5.47.65.F10.1.454.light.4.raw

SEQ ID NO: 599491 - DNA, 484 bp, Homo sapiens
  misc_feature: HIJSMM301AQFGP.10.53.E09.1.454.light.4.raw
catagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttatcagctccgacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgcggcagtttattactgtcagcactattatagtaccccattcacattcggccctgggaccaaagtggagatcaaacga

SEQ ID NO: 599492 - DNA, 491 bp, Homo sapiens; identical to SEQ ID NO: 550637
  misc_feature: HIJSMM301ADBVB.51.28.C06.1.454.light.4.raw

SEQ ID NO: 599493 - DNA, 501 bp, Homo sapiens
  misc_feature: HIJSMM301C7G3L.40.33.C11.1.454.light.4.raw
  modified_base (372)..(372): a, c, t, g, unknown or other
tctagcgactcacgaccggtgctcgatttagagtgagctcgttgggtttgggcacgaccggtgctcgatttagagtgagctcgttgggtttggggggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtncctgatcgcttctctgcctccatccttgggaacaaagctgccctcaccattacggggcccagccagaggatgagtcttattattactgcatgctccatgtggggggtgccacttgggtgttcggcggac

SEQ ID NO: 599494 - DNA, 495 bp, Homo sapiens; identical to SEQ ID NO: 562352
  misc_feature: HIJSMM301DA25V.40.39.D06.1.454.light.4.raw

SEQ ID NO: 599495 - DNA, 485 bp, Homo sapiens; identical to SEQ ID NO: 535985
  misc_feature: HIJSMM301DIBSR.15.1.A01.1.454.light.4.raw

SEQ ID NO: 599496 - DNA, 503 bp, Homo sapiens; identical to SEQ ID NO: 543109
  misc_feature: HIJSMM301CUKY7.19.78.H01.1.454.light.4.raw

SEQ ID NO: 599497 - DNA, 485 bp, Homo sapiens; identical to SEQ ID NO: 543370
  misc_feature: HIJSMM301EGCGB.3.10.A10.1.454.light.4.raw

SEQ ID NO: 599498 - DNA, 517 bp, Homo sapiens
  misc_feature: HIJSMM301DH1ZT.40.14.B03.1.454.light.4.raw
tctagcgactcacgaccggtgctcgatttagtgtgagtagttccgcggggtggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggcaacaattgggtcttcggcggagggaccaagctgaccgtcctaggtcagcccaaggctgccccctcggtccactctgttccccg

SEQ ID NO: 599499 - DNA, 505 bp, Homo sapiens
  misc_feature: HIJSMM301CI4V9.22.15.B04.1.454.light.4.raw
acatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaggatgaggctgattattactgcagctcatatggaggcagcgacaatttgggtgttcggcggaggggaccaagctgaccgtcctaggtcagcccaaggctgccccctcggtcta

SEQ ID NO: 599500 - DNA, 509 bp, Homo sapiens
  misc_feature: HIJSMM301D9P38.11.57.F02.1.454.light.4.raw
  modified_base (491)..(491): a, c, t, g, unknown or other
cgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatcngtctcatcttcccgccat

SEQ ID NO: 599501 - DNA, 477 bp, Homo sapiens
  misc_feature: HIJSMM301C62A7.16.86.H09.1.454.light.4.raw
tgtactactccacgaccggtgctcgatttagtgctatagacttgggtttggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgccccctggtcactctgttcccgccctcctcgagtagtaca

SEQ ID NO: 599502 - DNA, 493 bp, Homo sapiens; identical to SEQ ID NO: 540127
  misc_feature: HIJSMM301D76DJ.10.17.B06.1.454.light.4.raw

SEQ ID NO: 599503 - DNA, 454 bp, Homo sapiens; identical to SEQ ID NO: 536943
  misc_feature: HIJSMM301E3BZD.19.86.H09.1.454.light.4.raw

SEQ ID NO: 599504 - DNA, 486 bp, Homo sapiens
  misc_feature: HIJSMM301CRG2G.5.45.E01.1.454.light.4.raw
atcagacacgcacgaccggtgctcgatttagtgagtcagtaagggaaaggggggagtcagacccagtcaggacacagcatggacatgagggtccccgctcagctcctggggctcctgctgctctggttcccaggttccagatgcgacatccagatgacccagtctccttctttcgtgtctgcgtctgtaggagacagacttactatcgcttgtcgggcgagtcaggatattagtaccaggttagcctggtatcagcagaagcctgggagagcccctaaactcctgatctatgctgcatcaagtctgcaaagtggggtcccatcgaggttcagaggcagtggatctgggacagatttcactctcaccatcagcggcctgcagcctgaagattatgcaacttactattgtcaaagttctaatgctttcccgcgtcacgtttggccagggggaccaaggtagagatcaaacgaactgtggctgcaccat

SEQ ID NO: 599505 - DNA, 487 bp, Homo sapiens; identical to SEQ ID NO: 543396
  misc_feature: HIJSMM301BSO0X.46.26.C04.1.454.light.4.raw

SEQ ID NO: 599506 - DNA, 498 bp, Homo sapiens
  misc_feature: HIJSMM301C1MLX.48.82.H05.1.454.light.4.raw
agtatacatacacgaccggtgctcgatttagtcgagctctctcgcgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgatttattactgcacctcatatacaagcagcagcactctcgtggtattcggcggagggaccaagctgaccgtcctaggtcagcccaaggctcg

SEQ ID NO: 599507 - DNA, 509 bp, Homo sapiens; identical to SEQ ID NO: 541168
  misc_feature: HIJSMM301EZM9U.5.60.F05.1.454.light.4.raw

SEQ ID NO: 599508 - DNA, 504 bp, Homo sapiens; identical to SEQ ID NO: 568334
  misc_feature: HIJSMM301EIHWS.12.48.E04.1.454.light.4.raw

SEQ ID NO: 599509 - DNA, 492 bp, Homo sapiens
  misc_feature: HIJSMM301CYU95.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatccaccttcggccaagggacacgactggagattaaacgactgtgctgcacatctgtctt

SEQ ID NO: 599510 - DNA, 354 bp, Homo sapiens; identical to SEQ ID NO: 598006
  misc_feature: HIJSMM301EN2NF.40.9.A09.1.454.light.4.raw

SEQ ID NO: 599511 - DNA, 498 bp, Homo sapiens; identical to SEQ ID NO: 547576
  misc_feature: HIJSMM301DSZB7.12.37.D04.1.454.light.4.raw

SEQ ID NO: 599512 - DNA, 485 bp, Homo sapiens; identical to SEQ ID NO: 538787
  misc_feature: HIJSMM301BH826.49.57.F02.1.454.light.4.raw

SEQ ID NO: 599513 - DNA, 488 bp, Homo sapiens; identical to SEQ ID NO: 556336
  misc_feature: HIJSMM301ALKVO.48.75.G09.1.454.light.4.raw

SEQ ID NO: 599514 - DNA, 497 bp, Homo sapiens; identical to SEQ ID NO: 536371
  misc_feature: HIJSMM301B1YOX.16.78.H01.1.454.light.4.raw

SEQ ID NO: 599515 - DNA, 456 bp, Homo sapiens
  misc_feature: HIJSMM301EK6S4.40.76.G10.1.454.light.4.raw
tctagcgactcacgaccggtgctcgatttagtcactcatacagggggcagaagtctctctcagtcaggacacagcatggacatgagggtccctgctcagctcctgggactcctgctgctctggctcccagataccagatgtgacatccagatgacccagtctccatcttccctgtctgcgtctgtaggagacagagtcaccatcacttgccgggcgagtcaggacattggcatttatgtagcctggtataaggagacaccaggaaaagttcctcaactcctgatctatggtgcatccactctgcacttcggggtcccatctcggttcagcggcagcggatctgggacacatttcactctcaccatcagcagcctgcagcctgaagatgttgcagtttattactgtcaaagtatgacactgtcccgctcactttcggcggagggaccaaggtggaga

SEQ ID NO: 599516 - DNA, 491 bp, Homo sapiens
  misc_feature: HIJSMM301AID14.11.12.B01.1.454.light.4.raw
cgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaaataccaggcggccctctggggtccctgagcgattctccggctccggctctgggaacacagtcactctgaccatcagcgggacccaggctattgatgaggctgtctacttctgtcaggcgtgggacaacagcgtggtgttcggcggagggaccagtctgaccgtcttaggtcagcccaaggc

SEQ ID NO: 599517 - DNA, 504 bp, Homo sapiens
  misc_feature: HIJSMM301EVPRA.4.71.G05.1.454.light.4.raw
agcactgtagcacgaccggtgctcgatttagtgtcgtcgcaagagagaggggggtgggctcaggaggcagagctctgggaatctcactatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaactgaccgtcctaggtcagcccaaggctgccccctcggtcattctgtt

SEQ ID NO: 599518 - DNA, 495 bp, Homo sapiens
  misc_feature: HIJSMM301EV85I.40.33.C11.1.454.light.4.raw
tctagcgactcacgaccggtgctcgatttagagtgagctcgttgggtttggggagctgggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagcccagaggatgagtcttattattactgcatgctccatgtgggggtgccacttgggtgttcggcggaggggaccaagctgaccgtcctaggtcagccc

SEQ ID NO: 599519 - DNA, 485 bp, Homo sapiens
  misc_feature: HIJSMM301C9YUV.21.55.E11.1.454.light.4.raw
tcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattatttgccggacaagtcacgacataaacacctttttaaattggtatcagcacaaaccagggaaggccccaaagctcctgatcgatgctgcatccaatttagagagtggggtcccatccaggttcagtggcgatggatctgggacaaatttcactctcaccatcagcagtctgcaacctgaagattttgcaacttactattgtcaacagagttacagtattcctttcactttcggccctgggaccgaagtcgatatcaaacgaactgtgctgcacatctgt

SEQ ID NO: 599520 - DNA, 488 bp, Homo sapiens; identical to SEQ ID NO: 584093
  misc_feature: HIJSMM301AIHTN.51.71.G05.1.454.light.4.raw

SEQ ID NO: 599521 - DNA, 488 bp, Homo sapiens
  misc_feature: HIJSMM301CBDGI.43.33.C11.1.454.light.4.raw
tgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccactcggttcagtggcaacggctctgagacagatttttctctcgtcatcactggtctacagtctgacgacggcgcaatgtacttctgtcaacactatgcctctcccccctacaactttcggtcaggggaccaagttgaacatcaatcgaactgtggctgcaccat

SEQ ID NO: 599522 - DNA, 498 bp, Homo sapiens
  misc_feature: HIJSMM301D70YR.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggaggaccaaggtggagatcaaacgactgtggctgcacatctgtctt

SEQ ID NO: 599523 - DNA, 506 bp, Homo sapiens
  misc_feature: HIJSMM301EE8TW.47.55.E11.1.454.light.4.raw
agctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctagggcacgtgagactcaggaaatgaccagaggggagtgaatggaggggtgcagagaactccatggctaccaggtcagcccaaggcccaaccccactgtcactctcgttcccaccctcctcta

SEQ ID NO: 599524 - DNA, 474 bp, Homo sapiens; identical to SEQ ID NO: 561309
  misc_feature: HIJSMM301C26EU.5.12.B01.1.454.light.4.raw

SEQ ID NO: 599525 - DNA, 510 bp, Homo sapiens
  misc_feature: HIJSMM301AR72L.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgacttgcagtttatttctgtcagcagtctgaagactggccgttcactttcggcggagggaccgaaggtcggacctcaaacgaactgtggctgcaccatctgtcttcatcttcccgccactc

SEQ ID NO: 599526 - DNA, 495 bp, Homo sapiens; identical to SEQ ID NO: 552273
  misc_feature: HIJSMM301ELHHR.43.73.G07.1.454.light.4.raw

SEQ ID NO: 599527 - DNA, 497 bp, Homo sapiens; identical to SEQ ID NO: 535286
  misc_feature: HIJSMM301A8YDC.18.59.F04.1.454.light.4.raw

SEQ ID NO: 599528 - DNA, 495 bp, Homo sapiens
  misc_feature: HIJSMM301AICT2.9.1.A01.1.454.light.4.raw
  modified_base (471)..(471): a, c, t, g, unknown or other
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaaggacacgactggagattaaaggaactagtggctgnaccatctgtcttctatcttccccg

SEQ ID NO: 599529 - DNA, 506 bp, Homo sapiens
  misc_feature: HIJSMM301DZNUI.17.41.D08.1.454.light.4.raw
cgtagactagcacgaccggtgctcgatttagtcacgcgagaaagggaaaggggagagctgctcagttaggacccagagggaaccatggaaaccccagcgcagcttctcttcctcctgctactctggcacccagataccaccggagaaattgtgttgacgcagtctccaggcaccctgtccttgtctccaggggaaacagccaccctctcctgtagggccagtcagagttgtttttaaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaatatggtggtacacccctcactttcggcggagggccaaggtggagatcaagcgaactgtggctgcaccatctgtcttcatcttcccgcc

SEQ ID NO: 599530 - DNA, 487 bp, Homo sapiens; identical to SEQ ID NO: 568467
  misc_feature: HIJSMM301DFRYW.51.73.G07.1.454.light.4.raw

SEQ ID NO: 599531 - DNA, 501 bp, Homo sapiens; identical to SEQ ID NO: 536142
  misc_feature: HIJSMM301A8NPR.15.1.A01.1.454.light.4.raw

SEQ ID NO: 599532 - DNA, 486 bp, Homo sapiens
  misc_feature: HIJSMM301BBSJR.17.21.B10.1.454.light.4.raw
  modified_base (431)..(431): a, c, t, g, unknown or other
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggacacnctggcgttcctactttgtcgacgggacggaaacctagagaatcagagaacgaagt

SEQ ID NO: 599533 - DNA, 504 bp, Homo sapiens; identical to SEQ ID NO: 538977
  misc_feature: HIJSMM301D6U09.48.37.D04.1.454.light.4.raw

SEQ ID NO: 599534 - DNA, 517 bp, Homo sapiens
  misc_feature: HIJSMM301B0V7N.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttattttgtcaacaggtactaacttacccttccctcttacgttcggagggacggaacgaggtaggatactacgacggaccgtaacgtggtcgtcgtcgaccaactcttcgttcttctta

SEQ ID NO: 599535 - DNA, 496 bp, Homo sapiens
  misc_feature: HIJSMM301CK3PV.40.63.F08.1.454.light.4.raw
tctagcgactcacgaccggtgctcgatttagcgatcgtataagggggagtcagtctcagtcaggacacagcatggacatgagggtccccgctcagctcctggggctcctgctactctggctccgaggtgccacatgtgacatccagatgacccagtctccatcctccctgtctgcatccgtaggggacagagtcaccatcgcttgccgggcaagtcagcccatgaccaatcatttaagttggtatcagcagaaaccagggaaagcccctagactcctgatctatactgcgtccactttgcaaggtggggtcccccaaggttcagtggcagtggatctgagacagatttcagtcttactatcagcaatctgcaacctgaagattttgcgacttactactgcctacagacttacgacttcccgtggacgttcggccaagggaccaaggtggaaatcaaacgaactgtggctgcaccatctgtcttcatcttcccgcca

SEQ ID NO: 599536 - DNA, 498 bp, Homo sapiens
  misc_feature: HIJSMM301BAF11.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggccccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggaccgaaggtggaggttcaaacgaactgtggctgcaccactctgtcttcatt

SEQ ID NO: 599537 - DNA, 492 bp, Homo sapiens
  misc_feature: HIJSMM301D23MN.53.6.A06.1.454.light.4.raw
cgcgtatacacacgaccggtgctcgatttagatctactgacagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatggattgccaaagcactatggttactggtaccaacagaagccaggccaggcccctctattggtaatgtataaagacaatgagaggccctcagggatccctgagcgattctctggctccaactcagggacaacagtcacgttgaccatcggtggagtccaggcagaagacgaggctgactattactgtcaatcagcaggcagcagtggaactgtgcttttcggcggagggaccaagctgaccgtcctacgtcagcccaaggctgcccctcggtcactc

SEQ ID NO: 599538 - DNA, 497 bp, Homo sapiens; identical to SEQ ID NO: 536371
  misc_feature: HIJSMM301BI911.16.78.H01.1.454.light.4.raw

SEQ ID NO: 599539 - DNA, 508 bp, Homo sapiens; identical to SEQ ID NO: 552440
  misc_feature: HIJSMM301D0MHV.5.24.C02.1.454.light.4.raw

SEQ ID NO: 599540 - DNA, 513 bp, Homo sapiens
  misc_feature: HIJSMM301E1MNG.48.66.F11.1.454.light.4.raw
agtatacatacacgaccggtgctcgatttagtcacgcgagaaaggggggaagcctgagaacacttagccttcatgagtgtccccaccatggcctggatgatgcttctcctcggactccttgcttatggatcaggcgtgcattctcagagtgtggtgacccaggaaccatcgttctcagtgtcccctggagggacagtcacactcacttgtggcttgacttctggctcagtcgcgccggtccactaccccagttggtaccaacagatcccaggccaggctccacgcacgctcatcttcatgaaacagattcgctcttctggggtccctgatcggttttctggctccatcgttgggggcaaagccgccctcaccatcacgggggcccaggcagaggatgaggcgaattattattgtatgctccacaggggcaggggcacctgggagttcggcggcgggaccaagctgaccgtcctaggtcagcccaaggctgccccctcggtcactctgttccca

SEQ ID NO: 599541 - DNA, 498 bp, Homo sapiens
  misc_feature: HIJSMM301BV7UW.49.46.E02.1.454.light.4.raw
agtcgagagacacgaccggtgctcgatttagactcatctacagggaaagggggtgggtccaggaggcagaaccctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcactctcg

SEQ ID NO: 599542 - DNA, 501 bp, Homo sapiens; identical to SEQ ID NO: 538431
  misc_feature: HIJSMM301DH3ON.21.22.B11.1.454.light.4.raw

SEQ ID NO: 599543 - DNA, 444 bp, Homo sapiens; identical to SEQ ID NO: 534993
  misc_feature: HIJSMM301CE2UN.5.9.A09.1.454.light.4.raw

SEQ ID NO: 599544 - DNA, 501 bp, Homo sapiens; identical to SEQ ID NO: 548357
  misc_feature: HIJSMM301BX9KB.19.67.G01.1.454.light.4.raw

SEQ ID NO: 599545 - DNA, 384 bp, Homo sapiens
  misc_feature: HIJSMM301AHM07.48.23.C01.1.454.light.4.raw
agtatacatacacgaccggtgctcgatttagtacacgtgattagggattgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcacca

SEQ ID NO: 599546 - DNA, 444 bp, Homo sapiens; identical to SEQ ID NO: 539971
  misc_feature: HIJSMM301ERRRD.8.73.G07.1.454.light.4.raw
  modified_base (426)..(426): a, c, t, g, unknown or other

SEQ ID NO: 599547 - DNA, 496 bp, Homo sapiens; identical to SEQ ID NO: 535109
  misc_feature: HIJSMM301BXNBE.16.78.H01.1.454.light.4.raw

SEQ ID NO: 599548 - DNA, 420 bp, Homo sapiens; identical to SEQ ID NO: 540533
  misc_feature: HIJSMM301BVVZV.9.34.D01.1.454.light.4.raw

SEQ ID NO: 599549 - DNA, 495 bp, Homo sapiens; identical to SEQ ID NO: 554164
  misc_feature: HIJSMM301DDZTM.27.78.H01.1.454.light.4.raw

SEQ ID NO: 599550 - DNA, 522 bp, Homo sapiens
  misc_feature: HIJSMM301ALWNT.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtcgtcccccggacgttcgtccgacgggaccgaccacgtagaaataggagaacgaacgtacgtggtcgtgccaccactctcgttcttcctattcttcccgt

SEQ ID NO: 599551 - DNA, 500 bp, Homo sapiens; identical to SEQ ID NO: 546613
  misc_feature: HIJSMM301C2642.11.21.B10.1.454.light.4.raw

SEQ ID NO: 599552 - DNA, 514 bp, Homo sapiens
  misc_feature: HIJSMM301EASL6.51.53.E09.1.454.light.4.raw
cgatcgtatacacgaccggtgctcgatttagagagagtgtgttgggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacagaaacacttgggtgttcggcggcgggaccaaactgaccgtcctacgtcagcccaaggctcgccccctcggtcactctcg

SEQ ID NO: 599553 - DNA, 491 bp, Homo sapiens; identical to SEQ ID NO: 565902
  misc_feature: HIJSMM301EOS7A.22.65.F10.1.454.light.4.raw

SEQ ID NO: 599554 - DNA, 506 bp, Homo sapiens
  misc_feature: HIJSMM301EB2PA.3.79.H02.1.454.light.4.raw
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggtatttggtgagggaccaagctgaccgtcctaggtcagcccaaggctgccccctcggt

SEQ ID NO: 599555 - DNA, 521 bp, Homo sapiens; identical to SEQ ID NO: 539470
  misc_feature: HIJSMM301C3AYG.27.23.C01.1.454.light.4.raw

SEQ ID NO: 599556 - DNA, 512 bp, Homo sapiens
  misc_feature: HIJSMM301B6GRN.40.33.C11.1.454.light.4.raw
tctagcgactcacgaccggtgctcgatttagagtgagctcgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcaggtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatgtggggggtgccacttgggtgttcggcggagggaccaagctgaccgtccg

SEQ ID NO: 599557 - DNA, 513 bp, Homo sapiens
  misc_feature: HIJSMM301ENQJ1.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcaacccaaataaagcccccaaactcatcatttatgatgccactaagcggccctcgaggggtttctaatcgcttctctggctccaagtctggcaacacggcctccctgacaatctctgggctccaggctgaggacgaggctgattactactgctgctcatatgcaggtctatctcttatgtcttcggaactgggaccaaggtccaccgtcctaggtcagccccaaaggcccaaacccccactgtcta

SEQ ID NO: 599558 - DNA, 482 bp, Homo sapiens; identical to SEQ ID NO: 557504
  misc_feature: HIJSMM301ELBG8.49.28.C06.1.454.light.4.raw

SEQ ID NO: 599559 - DNA, 494 bp, Homo sapiens; identical to SEQ ID NO: 534994
  misc_feature: HIJSMM301DGHNU.27.78.H01.1.454.light.4.raw

SEQ ID NO: 599560 - DNA, 486 bp, Homo sapiens; identical to SEQ ID NO: 535043
  misc_feature: HIJSMM301ANCNA.46.35.D02.1.454.light.4.raw

SEQ ID NO: 599561 - DNA, 476 bp, Homo sapiens
  misc_feature: HIJSMM301DT0MR.5.12.B01.1.454.light.4.raw
atcagacacgcacgaccggtgctcgatttagtagtgtagattccgcggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaacagtgacattggtgcttatgactatgtctcgtggtatcaaaagtatccagacacagcccccaaactcatcctttatgatgtccgtgttcggccctcaggggtttctgttcgcttctctggctccaagtctggcagcacggcctccctgaccatctctgggctccaggctgaggacgaggctgactattattgcagttcatatggtagtatgaagactcttgtgattttcggcggagggaccaagctgacccgt

SEQ ID NO: 599562 - DNA, 508 bp, Homo sapiens
  misc_feature: HIJSMM301DEFXS.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatctgttctactctcctcccg

SEQ ID NO: 599563 - DNA, 500 bp, Homo sapiens
  misc_feature: HIJSMM301C11M9.40.22.B11.1.454.light.4.raw
  modified_base (463)..(463): a, c, t, g, unknown or other
tctagcgactcacgaccggtgctcgatttagacgacagctcagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgaatagtaatggatacaactatttggattggtacctgcagaagccagggcagtgtccacagctcctgatctatttgggttctaatcgggcctccggggtccctgacaggttcagtggcagtggatcaggtacagattttacactagaaaatcagcagagtggaggctgaggatgttgggtttattactgcatgcaagctctacaaattcctcggtacgtcggtccgaaggaccaaggnggaaatacaaacgaactgtggcgtgcgaccatcttcg

SEQ ID NO: 599564 - DNA, 517 bp, Homo sapiens
  misc_feature: HIJSMM301B5QS6.3.87.H10.1.454.light.4.raw
agacgcactccacgaccggtgctcgatttagcagtactgcgttgggtttgggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttgtctcctggtcctggtaccaaaaacacccaggcaaagcccccagattaatgatttatgatgtcagtgatcggccctcaggggtttctcatcgcttttctggctccaagtctggcaacacggcctccctgaccatctctgggctccaggctgaggacgaggctgattatttctgcagctcatacacaaccggcaccactgtcgtggttttcggtggagggaccaagctgaccgtcctaggtcagcccaaggctgccccctcggtcactt

SEQ ID NO: 599565 - DNA, 486 bp, Homo sapiens; identical to SEQ ID NO: 535458
  misc_feature: HIJSMM301BZCIY.7.75.G09.1.454.light.4.raw

SEQ ID NO: 599566 - DNA, 488 bp, Homo sapiens; identical to SEQ ID NO: 538811
  misc_feature: HIJSMM301BMUPA.40.83.H06.1.454.light.4.raw

SEQ ID NO: 599567 - DNA, 490 bp, Homo sapiens; identical to SEQ ID NO: 535234
  misc_feature: HIJSMM301C2UU6.17.21.B10.1.454.light.4.raw

SEQ ID NO: 599568 - DNA, 521 bp, Homo sapiens; identical to SEQ ID NO: 538715
  misc_feature: HIJSMM301C9MAM.27.23.C01.1.454.light.4.raw

SEQ ID NO: 599569 - DNA, 496 bp, Homo sapiens; identical to SEQ ID NO: 535109
  misc_feature: HIJSMM301DMPGB.16.78.H01.1.454.light.4.raw

SEQ ID NO: 599570 - DNA, 502 bp, Homo sapiens
  misc_feature: HIJSMM301DX581.48.83.H06.1.454.light.4.raw
agtatacatacacgaccggtgctcgatttagatcacgtgcgtcgcgggggggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcgggggaccaggctgaccgtcggcggtcagcccaaggctgcccctcggtcactctgtcccgccctcct

SEQ ID NO: 599571 - DNA, 496 bp, Homo sapiens
  misc_feature: HIJSMM301DNFVY.22.5.A05.1.454.light.4.raw
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctggccaggctcccaggctcctcatctatgatgcatcttacagggccactggcatcccagccaggttcagtggcagtgggtctgggacagacttcactctcaccatcagcagcctagagcctgaagattttgcagttttattactgtcagcagcgtagcaactccctcacgttcggcggagggaccaaggtggagatcaaacgaactgtggctgcaccatctgtcttcatcttcccgcc

SEQ ID NO: 599572 - DNA, 500 bp, Homo sapiens; identical to SEQ ID NO: 539563
  misc_feature: HIJSMM301D7L7J.8.2.A02.1.454.light.4.raw

SEQ ID NO: 599573 - DNA, 504 bp, Homo sapiens; identical to SEQ ID NO: 535561
  misc_feature: HIJSMM301A84LN.4.57.F02.1.454.light.4.raw

SEQ ID NO: 599574 - DNA, 506 bp, Homo sapiens; identical to SEQ ID NO: 554189
  misc_feature: HIJSMM301BT200.19.78.H01.1.454.light.4.raw

SEQ ID NO: 599575 - DNA, 444 bp, Homo sapiens; identical to SEQ ID NO: 535192
  misc_feature: HIJSMM301CA0WN.5.9.A09.1.454.light.4.raw

SEQ ID NO: 599576 - DNA, 505 bp, Homo sapiens
  misc_feature: HIJSMM301AGY8L.48.41.D08.1.454.light.4.raw
agtatacatacacgaccggtgctcgatttagtcacgcgagaaagggaaaggggagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttccccg

SEQ ID NO: 599577 - DNA, 507 bp, Homo sapiens
  misc_feature: HIJSMM301BIRFD.16.1.A01.1.454.light.4.raw
tgtactactccacgaccggtgctcgatttagacgtctcatcagggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctcgccccctcggtcactctgtt

SEQ ID NO: 599578 - DNA, 455 bp, Homo sapiens
  misc_feature: HIJSMM301D1E2N.18.78.H01.1.454.light.4.raw
tacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcactctcgttcccgccctcctccatactcgta

SEQ ID NO: 599579 - DNA, 496 bp, Homo sapiens; identical to SEQ ID NO: 538619
  misc_feature: HIJSMM301A4JCD.12.37.D04.1.454.light.4.raw

SEQ ID NO: 599580 - DNA, 510 bp, Homo sapiens
  misc_feature: HIJSMM301CAWP4.21.87.H10.1.454.light.4.raw
tcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaaactcttaatttctggcgtcaattagcgaccctcacatgtttccagtcgattctctgcatccaagtctggcaacacggcctttctgacaatctctcaactccaggctgaagacgaggctatttattactgctcctcatacgcaggtggcacatttttcttggtttttggcggcgggacccagatgactgtcctcagtcagcccaaggctgccccctggtccta

SEQ ID NO: 599581 - DNA, 503 bp, Homo sapiens; identical to SEQ ID NO: 590269
  misc_feature: HIJSMM301EO28T.17.27.C05.1.454.light.4.raw

SEQ ID NO: 599582 - DNA, 494 bp, Homo sapiens; identical to SEQ ID NO: 535276
  misc_feature: HIJSMM301DELS7.16.6.A06.1.454.light.4.raw

SEQ ID NO: 599583 - DNA, 505 bp, Homo sapiens
  misc_feature: HIJSMM301ASKV4.18.59.F04.1.454.light.4.raw
tacgagtatgcacgaccggtgctcgatttagtacacacacttagggagttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgatttattactgcagctcatatacaagcaccagcactctctatgtcttcggaactgggaccaaggtcaccgtcctaggtcagcccaaggccaacccta

SEQ ID NO: 599584 - DNA, 501 bp, Homo sapiens
  misc_feature: HIJSMM301CESJ0.48.37.D04.1.454.light.4.raw
agtatacatacacgaccggtgctcgatttagtagcatactgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaaggctgaccgtcctaggtcagcccaaggctgccccctc

SEQ ID NO: 599585 - DNA, 506 bp, Homo sapiens
  misc_feature: HIJSMM301BPHZL.51.2.A02.1.454.light.4.raw
cgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattacctgtgggggaaacaacattggaagtaaaactgtgcactggtaccagcagaagccaggccaggcccctgtgctggtcgtctatgatgatgccgaccggccctcagggatccctgaacgattctctggctccagctctgagaacacggccaccctgagcatcagcgagggtcgaaggccggggatgaggccgactattactgtcaggtgtgggatactagtagtgatcatgtcttcggactgggaccaaggtcaccgtcctaggtcagccaacggccaacccactgtctactctcgttcccacctt

SEQ ID NO: 599586 - DNA, 508 bp, Homo sapiens
  misc_feature: HIJSMM301EBPSL.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctacttggtggtgctgtgctattcggcggaggaccaagctgaccgtctaagtcagcccaaggctgcccctcggtcactctgttcccacctcct

SEQ ID NO: 599587 - DNA, 496 bp, Homo sapiens; identical to SEQ ID NO: 547168
  misc_feature: HIJSMM301BDOAL.8.10.A10.1.454.light.4.raw

SEQ ID NO: 599588 - DNA, 491 bp, Homo sapiens; identical to SEQ ID NO: 553956
  misc_feature: HIJSMM301CXYD2.4.22.B11.1.454.light.4.raw

SEQ ID NO: 599589 - DNA, 514 bp, Homo sapiens
  misc_feature: HIJSMM301DEYE7.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccaccctgaccatcagcgcggtcgaagccggagatgaggccgactattactgtcaggtgtgggacaggtaatagtgatcccgagcaggtttcggcggtgggaccaagctgaccgtcctaagtcagcccaaggctgccccctcggtcactctgttccccg

SEQ ID NO: 599590 - DNA, 475 bp, Homo sapiens; identical to SEQ ID NO: 551151
  misc_feature: HIJSMM301DT25U.13.76.G10.1.454.light.4.raw

SEQ ID NO: 599591 - DNA, 493 bp, Homo sapiens; identical to SEQ ID NO: 535084
  misc_feature: HIJSMM301CNT17.47.64.F09.1.454.light.4.raw

SEQ ID NO: 599592 - DNA, 485 bp, Homo sapiens; identical to SEQ ID NO: 535985
  misc_feature: HIJSMM301CV8BJ.15.1.A01.1.454.light.4.raw

SEQ ID NO: 599593 - DNA, 508 bp, Homo sapiens
  misc_feature: HIJSMM301B291G.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatctgggacacatttcaccctcaccatcaatagcctggaagctgaagatgctgcaacttattactgtcatcagagtactactttacctctaagtgatctaccttcggccaagggacacgactggagaattaaaacg

SEQ ID NO: 599594 - DNA, 514 bp, Homo sapiens; identical to SEQ ID NO: 575177
  misc_feature: HIJSMM301D0APJ.17.33.C11.1.454.light.4.raw

SEQ ID NO: 599595 - DNA, 498 bp, Homo sapiens
  misc_feature: HIJSMM301CRWWV.26.72.G06.1.454.light.4.raw
agactatactcacgaccggtgctcgatttagctacgactgcaagggaaaggggcaacaagatggtgttgcagacccaggtcttcatttctctgttgctctggatctctggtgcccgcgggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtacacttttggccaggggacccaggtggagatcagacgaactgtggctgcaccatctgtcttcatcttcccgccta

SEQ ID NO: 599596 - DNA, 513 bp, Homo sapiens
  misc_feature: HIJSMM301C9PU9.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctggtcactctgttcccaccctcctcgctacgtagac

SEQ ID NO: 599597 - DNA, 473 bp, Homo sapiens; identical to SEQ ID NO: 547830
  misc_feature: HIJSMM301E2WAM.15.81.H04.1.454.light.4.raw

SEQ ID NO: 599598 - DNA, 476 bp, Homo sapiens; identical to SEQ ID NO: 538611
  misc_feature: HIJSMM301EFPY2.7.81.H04.1.454.light.4.raw

SEQ ID NO: 599599 - DNA, 488 bp, Homo sapiens; identical to SEQ ID NO: 543022
  misc_feature: HIJSMM301AR8RV.9.59.F04.1.454.light.4.raw

SEQ ID NO: 599600 - DNA, 502 bp, Homo sapiens
  misc_feature: HIJSMM301D3RRM.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcgagggaccaagctgaccgtctgggtcagcccaaggctgccccctcggtcta

SEQ ID NO: 599601 - DNA, 511 bp, Homo sapiens; identical to SEQ ID NO: 541549
  misc_feature: HIJSMM301BCDMY.40.33.C11.1.454.light.4.raw

SEQ ID NO: 599602 - DNA, 494 bp, Homo sapiens; identical to SEQ ID NO: 552502
  misc_feature: HIJSMM301B1OMN.13.11.A11.1.454.light.4.raw

SEQ ID NO: 599603 - DNA, 512 bp, Homo sapiens
  misc_feature: HIJSMM301ETAQR.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgttcggtccagggaccgaccagtagaaatagaagacgaacgtagtggctggcaccactctgtcttcctatcttcccgt

SEQ ID NO: 599604 - DNA, 499 bp, Homo sapiens
  misc_feature: HIJSMM301DGDTC.40.42.D09.1.454.light.4.raw
tctagcgactcacgaccggtgctcgatttagacacatacgcagggaaagggggtgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagaagcattgaccaaaaaaatatgcttattggtaccaacagaagtcaggccaggcccctgtgctggtcatctatgaggacaacaaacgaccctccgagatccctgagagattctctggctccagctcagggacaatggccaccttggctctcagtgggccaggtggaggatgaagctgactactactgttactcagtggacagcagtggaaatcatgggtattcggcggagggaccaagctgaccgtcctaggtcagcccaaggctgccccctcggtcactc

SEQ ID NO: 599605 - DNA, 480 bp, Homo sapiens; identical to SEQ ID NO: 557916
  misc_feature: HIJSMM301C08JA.51.76.G10.1.454.light.4.raw

SEQ ID NO: 599606 - DNA, 497 bp, Homo sapiens; identical to SEQ ID NO: 544674
  misc_feature: HIJSMM301BVIL2.40.59.F04.1.454.light.4.raw

SEQ ID NO: 599607 - DNA, 460 bp, Homo sapiens; identical to SEQ ID NO: 537107
  misc_feature: HIJSMM301A89NV.22.28.C06.1.454.light.4.raw

SEQ ID NO: 599608 - DNA, 488 bp, Homo sapiens
  misc_feature: HIJSMM301D9441.49.37.D04.1.454.light.4.raw
agtcgagagacacgaccggtgctcgatttagtagcatactgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggcagaggacgaggctgactattactgtcagtcatcagacagtagtggcacttctgttcgtattcggcggagggaccaagctgaccgtcctaggtcagcccaaggctccg

SEQ ID NO: 599609 - DNA, 501 bp, Homo sapiens; identical to SEQ ID NO: 536142
  misc_feature: HIJSMM301B7P3Y.15.1.A01.1.454.light.4.raw

SEQ ID NO: 599610 - DNA, 494 bp, Homo sapiens; identical to SEQ ID NO: 562936
  misc_feature: HIJSMM301DGLN3.10.60.F05.1.454.light.4.raw

SEQ ID NO: 599611 - DNA, 495 bp, Homo sapiens; identical to SEQ ID NO: 558808
  misc_feature: HIJSMM301AH01X.51.39.D06.1.454.light.4.raw

SEQ ID NO: 599612 - DNA, 520 bp, Homo sapiens; identical to SEQ ID NO: 546218
  misc_feature: HIJSMM301AY5EK.12.71.G05.1.454.light.4.raw

SEQ ID NO: 599613 - DNA, 509 bp, Homo sapiens
  misc_feature: HIJSMM301BODBW.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtcgtgcagcctgaggacgaggctgactattactgcctactctactttggtggtgctgtgctattcggcggagggaccaagctgaccgtcttaagtcagcccaaggctgccccctggtcactctgttcccg

SEQ ID NO: 599614 - DNA, 480 bp, Homo sapiens; identical to SEQ ID NO: 551245
  misc_feature: HIJSMM301D67E5.21.25.C03.1.454.light.4.raw

SEQ ID NO: 599615 - DNA, 508 bp, Homo sapiens; identical to SEQ ID NO: 536388
  misc_feature: HIJSMM301A1E0O.11.57.F02.1.454.light.4.raw

SEQ ID NO: 599616 - DNA, 460 bp, Homo sapiens; identical to SEQ ID NO: 536053
  misc_feature: HIJSMM301BHQYE.22.28.C06.1.454.light.4.raw

SEQ ID NO: 599617 - DNA, 483 bp, Homo sapiens
  misc_feature: HIJSMM301A1FT6.10.1.A01.1.454.light.4.raw
catagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatgggacaccggcctcagtgcggttgggttttcggcggagggaccaagctgaccgtcctaggtcacg

SEQ ID NO: 599618 - DNA, 520 bp, Homo sapiens
  misc_feature: HIJSMM301B8YQO.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcattttacaaccagccacaccttgctcttcggaactgggaccacggtcatcgtcctaggtcagcccaaggccaacccactgtcactctgttcccaccctcct

SEQ ID NO: 599619 - DNA, 494 bp, Homo sapiens; identical to SEQ ID NO: 535497
  misc_feature: HIJSMM301A0RB7.43.72.G06.1.454.light.4.raw

SEQ ID NO: 599620 - DNA, 507 bp, Homo sapiens
  misc_feature: HIJSMM301EC9PT.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattacttgcatgcaaactacacacggccgctcactttcggcggagggaccaaggtggagatcaaacgaactgtggctgcaccatctgtt

SEQ ID NO: 599621 - DNA, 521 bp, Homo sapiens; identical to SEQ ID NO: 538715
  misc_feature: HIJSMM301BIDGS.27.23.C01.1.454.light.4.raw

SEQ ID NO: 599622 - DNA, 444 bp, Homo sapiens; identical to SEQ ID NO: 535192
  misc_feature: HIJSMM301AYT9L.5.9.A09.1.454.light.4.raw

SEQ ID NO: 599623 - DNA, 518 bp, Homo sapiens; identical to SEQ ID NO: 555554
  misc_feature: HIJSMM301ADRC2.10.38.D05.1.454.light.4.raw

SEQ ID NO: 599624 - DNA, 491 bp, Homo sapiens
  misc_feature: HIJSMM301CS687.15.26.C04.1.454.light.4.raw
tctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaagcccctaactcctaatctatgatgcctccagtttggagagtgggtcccatctaggttcagcggcagtggatttgggacagaattcactctcaccatccgcagcctgcagcctgagattttgcaacttattactgccaacagtatatagcaattctccgtggacgttcggccaagggaccagggtggatatcaaacgaactgtggctgcaccatctgtcttcatt

SEQ ID NO: 599625 - DNA, 447 bp, Homo sapiens
  misc_feature: HIJSMM301BJB3V.48.38.D05.1.454.light.4.raw
agtatacatacacgaccggtgctcgatttagtatctgatagttgggtttggggggacgtcgtgatgacccagtctccagactccctggcagtgtctctgggcgggagggccaccatcaactgcaagtccagccagagtattttatacagctcctacaataagagcgacttagcttggtaccagcagaaaccaggacagcctcctaagttgctcatttactgggcatctaaccggcaatccggggtccctgaccgattcagtggcagcgggtctgggacacatttcgctttcaccatcagcagcctgcaggctgaggatgtggcagtttattactgtcagcaatattatactactccgtggactttcggccaagggaccaaggtggaaatcagacgaactgtggctgcaccatctgtcttcatcttcccgccatctgatatgtatact

SEQ ID NO: 599626 - DNA, 505 bp, Homo sapiens; identical to SEQ ID NO: 535503
  misc_feature: HIJSMM301BK41M.8.28.C06.1.454.light.4.raw

SEQ ID NO: 599627 - DNA, 491 bp, Homo sapiens; identical to SEQ ID NO: 535294
  misc_feature: HIJSMM301EKOM9.16.68.G02.1.454.light.4.raw

SEQ ID NO: 599628 - DNA, 506 bp, Homo sapiens
  misc_feature: HIJSMM301DEC4Q.48.41.D08.1.454.light.4.raw
agtatacatacacgaccggtgctcgatttagtcacgcgagaaagggaaaggggagagaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcaggtggcagtgggtctgggacagacttcactctcaccgtcagcagactggaccctgaagtattttgcagtgtattactgtcagcagtatggtagctcaccgatccaccttcggccgaagggacacgactggagattaaccgaactgtggctgcaccatctgtcttcta

SEQ ID NO: 599629 - DNA, 490 bp, Homo sapiens
  misc_feature: HIJSMM301BXZQF.40.8.A08.1.454.light.4.raw
tctagcgactcacgaccggtgctcgatttagcatactctacagggggctacaacaggcaggcaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccaaccagactgttttatacagctccaacaatgagaactacgttgcttggtaccagcagaaaccaggacagcctcctaagttgctcatttactgggcatctacccgggcatccggggtccctgaccgattcagtggcagcgggtctgggacagatttcactctcaccatcaacaacctgcaggctgaagatgtggcagtttattactgtcaacaatattatactactccgctcactttcggcgaggcaccaaggtggagatcagacgaactgtggctgcacca

SEQ ID NO: 599630 - DNA, 485 bp, Homo sapiens; identical to SEQ ID NO: 536695
  misc_feature: HIJSMM301A3MJB.10.1.A01.1.454.light.4.raw

SEQ ID NO: 599631 - DNA, 485 bp, Homo sapiens; identical to SEQ ID NO: 535688
  misc_feature: HIJSMM301DWSHM.19.5.A05.1.454.light.4.raw

SEQ ID NO: 599632 - DNA, 504 bp, Homo sapiens
  misc_feature: HIJSMM301BJ7DH.4.21.B10.1.454.light.4.raw
agcactgtagcacgaccggtgctcgatttagtgtcgtcgcaagagagagagaggagggggggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggaccccaaaattggtcatctatgaagacgacaaacgaccctcgggatccctgagagattctctggctccagctcagggactatggccaccttgactatcagtggggcccaagtggaggatgaagctgactactactgttactcaatagagaacagtgattaatttctgggtgttcggcggaggaccaaatcgaccgtctaggtcagccaaggctcgcccctcggtcactt

SEQ ID NO: 599633 - DNA, 479 bp, Homo sapiens
  misc_feature: HIJSMM301A04J9.48.45.E01.1.454.light.4.raw
agtatacatacacgaccggtgctcgatttagtgagtcagtaagggaaaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtgctaatacctatgtctcctggtaccaacaacacgcaggcaaagcccccaaactcatgatttatgatgtcactaagcggccctcagggtccctgctcgcttctctggctccaagtctggcaacacggcctccctgaccatctctgggctccaggctgaagatgaggctgattatttctgctgctcatatgcagccaactattatgtcttcggaactgagaccaaggtcaccgtcctaggtcag

SEQ ID NO: 599634 - DNA, 483 bp, Homo sapiens; identical to SEQ ID NO: 535413
  misc_feature: HIJSMM301ASZLQ.26.78.H01.1.454.light.4.raw

SEQ ID NO: 599635 - DNA, 494 bp, Homo sapiens
  misc_feature: HIJSMM301EF5ZH.8.81.H04.1.454.light.4.raw
ctcgcgtgtccacgaccggtgctcgatttagtagtgtagattcgcggggggagtcagacccagtcaggacacagcatggacatgagggtccccgctcagctcctggggctcctgctgctctggctcccaggtgccaactgtgacatccagatgacccagtcaccttccaccctgtctgcatctgtgggagacagagtcaccatcagttgccgggccagtcacagtattgacaatttgttggcctggtatcagcagaaaccaggaaaagccccgaacctcctgatctatcaggcgtctactttggaaagtggggtcccatcaaggttccgcggcagtggatctgggacagacttcactctcaccatcagcagcctgcagcctgatgattttgctacttattactgccaacagtatagtactttttctccggtacacttttgccgggggaccaagctggagatcaaacgaactgtggctgcaccatctgtcttcta

SEQ ID NO: 599636 - DNA, 506 bp, Homo sapiens
  misc_feature: HIJSMM301A9ERO.48.15.B04.1.454.light.4.raw
agtatacatacacgaccggtgctcgatttagacagtatatatccgcgggggctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaaactactcatttactcggcatccacccggaagtccgaggttcctgaccgattccgtggcagcgggtctgggacagattttactctcaccatcactaccctgcaggctgaagatgtggcagtttattactgtcaacaatattattctactccgccgacgttcggccgggggaccaacgtggaaatcaaacgaactgtggctgcaccatctgtcttcat

SEQ ID NO: 599637 - DNA, 503 bp, Homo sapiens
  misc_feature: HIJSMM301DRRRN.40.67.G01.1.454.light.4.raw
tctagcgactcacgaccggtgctcgatttagagtatacatattgggtttgggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtgggtctgggacagccttcactctcaccatcagcagcctggagcccgaagattttgcggtttattactgtcagcagcgtgccgactggcccctcacgttcggcggagggaccaaggtggacatcaaacgaactgtggctgcaccatctgtcttcatcttcccgcc

SEQ ID NO: 599638 - DNA, 499 bp, Homo sapiens
  misc_feature: HIJSMM301BM6LZ.51.29.C07.1.454.light.4.raw
cgatcgtatacacgaccggtgctcgatttagagtgctacgaagggaaagggggagggaactgctcagtcaggacccagacggaaccatggaagccccagcgcagcttctcttcctcctgctactctggctcccagatactactggagaaatagtgatgacgcagtctccagccacgctgtctgtgtctccgaggggaaagagccaccctctcctgcagggccagtcagagtgttaacaacaacttagcctggtatcagcagaaacctggccaggctcccaggctcctcatctttggatcatccatcagggccactggtgtcccagaaaagttcagtggcggtgggtctgacacagagtacaccctcaccatcagcaccctgcagtctgaagatgtcgcagtttattactgtcaacaatatagtgacaggccgccatggacgttcggccaagggaccgaaggtaggaaatgaaaggaactgtggctgcaccatctgtctt

SEQ ID NO: 599639 - DNA, 487 bp, Homo sapiens
  misc_feature: HIJSMM301DXN94.19.57.F02.1.454.light.4.raw
tactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaacccctaagctcctgatctatggtgcatccactttggaaagtggggtcccctcaaggttcagcggcagtggatctgggacagatttcactctcgccatcagcagcctgcagactgaagattttgcaacttatttttgtcaacaggctaacactttccccctcactttcggcggagggaccaaggtggagatcaagcgaactgtggctgcaccat

SEQ ID NO: 599640 - DNA, 511 bp, Homo sapiens; identical to SEQ ID NO: 548439
  misc_feature: HIJSMM301CP7L7.16.46.E02.1.454.light.4.raw

SEQ ID NO: 599641 - DNA, 499 bp, Homo sapiens
  misc_feature: HIJSMM301ANH9X.51.24.C02.1.454.light.4.raw
cgatcgtatacacgaccggtgctcgatttagtacagatcgttagggaaaggggtgatcaggactcctcagttcaccttctcacaatgaggctccctgctcagctcctggggctgctaatgctctgggtcccagcatccagtggagatgttgtgctgactcagtctccactctccctgtccgtcacccttggacagccagcttccatctcctgcaggtctagtcaaagcctcgtttatagtgttggaaacacctacttgaattggtttcatcagaggccgggccaatctccaaggcgcctgatttataaggtttctaaccgggactctggggtcccagacagattcagcggcagtgggtcaggcactcatttcacactgaggatcagcagggtggaggctgaggatgttggggtttattactgcatgcaaggtacacactggcctcctatcaccttcggccaagggacacgactggaggttaacgaactgtggctgcacc

SEQ ID NO: 599642 - DNA, 529 bp, Homo sapiens
  misc_feature: HIJSMM301EA5L5.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggccaacgggaccgaacggtaggaaggtacgaaacgaaaccgtagtggtcgtgcgaccactctgtcttctactcttcccgtccactctgat

SEQ ID NO: 599643 - DNA, 498 bp, Homo sapiens; identical to SEQ ID NO: 535914
  misc_feature: HIJSMM301ETS2P.18.59.F04.1.454.light.4.raw

SEQ ID NO: 599644 - DNA, 521 bp, Homo sapiens; identical to SEQ ID NO: 539470
  misc_feature: HIJSMM301B8SQW.27.23.C01.1.454.light.4.raw

SEQ ID NO: 599645 - DNA, 485 bp, Homo sapiens
  misc_feature: HIJSMM301EJV7S.52.53.E09.1.454.light.4.raw
cgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacaggcaggggggacggtatccctgatcgcttctcaggctccggctctgggactgagcgctacctcaccatctccagcctccagtctgaggacgagggtgactattactgtcagacgtgggacactggcatttgggtgttcggcggagggaccaagttgaccgtctaggtcagcccaaggctcg

SEQ ID NO: 599646 - DNA, 513 bp, Homo sapiens; identical to SEQ ID NO: 543780
  misc_feature: HIJSMM301AJS1M.17.33.C11.1.454.light.4.raw

SEQ ID NO: 599647 - DNA, 493 bp, Homo sapiens
  misc_feature: HIJSMM301EIHMX.41.64.F09.1.454.light.4.raw
tctatactatcacgaccggtgctcgatttagcgcgtatacaagggggaggttctttctctgggatgtggcatgagcaaaactgacaagtcaaggcaggaagatgttgccatcacaactcattgggtttctgctgctctgggttccagtctccaggggtgaaattgtgctgactcaatctccagactttcagtctgtgactccaaaggagaaagtcaccatcacctgccgggccagtcagagcattggttatagcttacactggtaccagcagaaaccagatcagcctccaaagctcctcatcaagtatgcttcccagtccatctcaggggtcccctcgaggttcagtggcagtggatctgggacagatttcaccctcaccatcaatagcctggaagctgaagatgttgcaacgtattactgtcatcagagtagtactttacctcggaccttcggccaaggacacgactggagattaaacgaactgtggctgca

SEQ ID NO: 599648 - DNA, 502 bp, Homo sapiens
  misc_feature: HIJSMM301EPRRY.41.53.E09.1.454.light.4.raw
tctatactatcacgaccggtgctcgatttagagagagtgtgttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgattaccatctcctgctctgggatcaacagcgaccttggtggttataactatgtgtcctggtaccaacaatatccaggcaaacccccaaagtcatcatttatgatgtcggtagtcggccctccggggtctctagtcgcttctctggctccaagtctggcaacacggcctccctgaccatctctgggctccaggctgaggacgaggctgactattactgcagttcatatacaagcagcagcactggagtcttcggaactgggaccagggtcaccgtcctaggtcagcccaaggccaaccccactg

SEQ ID NO: 599649 - DNA, 468 bp, Homo sapiens
  misc_feature: HIJSMM301D5N6U.3.20.B09.1.454.light.4.raw
agacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcgtctatttaaattggtatcagcacaaaccagggaaagcccctaagctcctgatctatgctgaatccactttgcaaagtggggtcccatcaaggttcagtggcagtggatctgggacagatttcactctaaccatcagcggtctgcaacctgaagattttgcaactcactactgtcaacagagtgacagcacgcctcacactttacggcggagggaccgaaggtggagatcaaacgaa

SEQ ID NO: 599650 - DNA, 505 bp, Homo sapiens
  misc_feature: HIJSMM301BV3GG.40.33.C11.1.454.light.4.raw
tctagcgactcacgaccggtgctcgatttagagtgagctcgttgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtgggtctgggacagccttcactctcaccatcagcagcctggagcccgaagattttgcggtttattactgtcagcagcgtgccgactggcccctcacgttcggcggagggaccaaggtggacatcaaacgaactgtggctgcaccatctgtcttcatcttcccgcc

SEQ ID NO: 599651 - DNA, 501 bp, Homo sapiens; identical to SEQ ID NO: 540528
  misc_feature: HIJSMM301BHH6K.11.31.C09.1.454.light.4.raw

SEQ ID NO: 599652 - DNA, 503 bp, Homo sapiens
  misc_feature: HIJSMM301CIOQC.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtctagccctaagccaacccctcgtagttcgaactcgtgttccccgaccctccgtccactacctacgaccaa

SEQ ID NO: 599653 - DNA, 501 bp, Homo sapiens
  misc_feature: HIJSMM301AD1MB.18.59.F04.1.454.light.4.raw
tacgagtatgcacgaccggtgctcgatttagtacacacacttagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaacccca

SEQ ID NO: 599654 - DNA, 500 bp, Homo sapiens
  misc_feature: HIJSMM301CRHZM.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggaggaccaagctgaccgtcctgcgtcagcccaaggctgccccctcggtcact

SEQ ID NO: 599655 - DNA, 493 bp, Homo sapiens; identical to SEQ ID NO: 535047
  misc_feature: HIJSMM301AI51R.16.53.E09.1.454.light.4.raw

SEQ ID NO: 599656 - DNA, 495 bp, Homo sapiens; identical to SEQ ID NO: 567588
  misc_feature: HIJSMM301D3MBK.3.36.D03.1.454.light.4.raw

SEQ ID NO: 599657 - DNA, 488 bp, Homo sapiens
  misc_feature: HIJSMM301CLE2B.11.12.B01.1.454.light.4.raw
cgagagataccacgaccggtgctcgatttagtagtgtagattccgcgggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagccgctctggagatgtcttgactaatgagtatgcttcctggtatcagcagaaggcaggccagccccctgtcctactcatctttcaaaataccaggcggccctctggggtccctgagcgattctccggctccggctctgggaacacagtcactctgaccatcagcgggacccaggctattgatgaggctgtctacttctgtcaggcgtgggacaacagcgtggtgttcggcggagggaccagtctgaccgtcttaggtcagcccaaggctgccccctcggtcact

SEQ ID NO: 599658 - DNA, 489 bp, Homo sapiens
  misc_feature: HIJSMM301E34BR.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagatttctgcaacttattactgtctccagtatgatgcttaccctcggactttcggccaagggaccaaggtggaaagtacaaacgaacctagtggctggcacca

SEQ ID NO: 599659 - DNA, 505 bp, Homo sapiens; identical to SEQ ID NO: 536254
  misc_feature: HIJSMM301DSW90.7.71.G05.1.454.light.4.raw

SEQ ID NO: 599660 - DNA, 475 bp, Homo sapiens
  misc_feature: HIJSMM301AYQS1.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgcctacttttggcggggggaccaagggtggacatcaaacggaa

SEQ ID NO: 599661 - DNA, 509 bp, Homo sapiens; identical to SEQ ID NO: 586865
  misc_feature: HIJSMM301DM0LL.9.33.C11.1.454.light.4.raw

SEQ ID NO: 599662 - DNA, 493 bp, Homo sapiens; identical to SEQ ID NO: 540127
  misc_feature: HIJSMM301CEYZL.10.17.B06.1.454.light.4.raw

SEQ ID NO: 599663 - DNA, 485 bp, Homo sapiens; identical to SEQ ID NO: 540008
  misc_feature: HIJSMM301EC4B9.5.41.D08.1.454.light.4.raw

SEQ ID NO: 599664 - DNA, 478 bp, Homo sapiens
  misc_feature: HIJSMM301EN94C.27.78.H01.1.454.light.4.raw
  modified_base (415)..(415): a, c, t, g, unknown or other
  modified_base (460)..(460): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagaaccaggtcagtctccaaaagctcctcactcaagtatgcttcccagtccttctcaggggtcccctcgaggttcagtggcagtggatctgggacacatttcaccctcaccatcaatagcctggaagctgaagatgctgcaacttattactgtcatcanagtactacttactcatagatcacctcgtccgacggacgacgaacncgagagtaaacaaactag

SEQ ID NO: 599665 - DNA, 521 bp, Homo sapiens; identical to SEQ ID NO: 539470
  misc_feature: HIJSMM301DUOO2.27.23.C01.1.454.light.4.raw

SEQ ID NO: 599666 - DNA, 505 bp, Homo sapiens; identical to SEQ ID NO: 535987
  misc_feature: HIJSMM301DSB56.18.37.D04.1.454.light.4.raw

SEQ ID NO: 599667 - DNA, 489 bp, Homo sapiens; identical to SEQ ID NO: 587984
  misc_feature: HIJSMM301CABXA.47.38.D05.1.454.light.4.raw

SEQ ID NO: 599668 - DNA, 496 bp, Homo sapiens
  misc_feature: HIJSMM301AWFEN.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaaggacgagggtggaaatacaaacgaactagtggctgcaccatctgtcttcatt

SEQ ID NO: 599669 - DNA, 505 bp, Homo sapiens; identical to SEQ ID NO: 539391
  misc_feature: HIJSMM301DSNRT.43.22.B11.1.454.light.4.raw

SEQ ID NO: 599670 - DNA, 522 bp, Homo sapiens
  misc_feature: HIJSMM301D05KZ.12.21.B10.1.454.light.4.raw
atacgacgtacacgaccggtgctcgatttagtgtcgtcgcaagagaggaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgtagggcactaagcggccctcaggagtttctgatcgcttctctggctccaaggctggcgaccgggcctccctgacaatatctgggctccaggctgaggacgaggctcattactactgctgctcatatggaggttatagcacttgggtggttcggcggtcgggaccgaagtgaccgtcctaagtcagcccaaggctgcccctcggtcactctgttccgccct

SEQ ID NO: 599671 - DNA, 515 bp, Homo sapiens; identical to SEQ ID NO: 564475
  misc_feature: HIJSMM301A06HZ.15.86.H09.1.454.light.4.raw

SEQ ID NO: 599672 - DNA, 497 bp, Homo sapiens
  misc_feature: HIJSMM301A54W6.53.38.D05.1.454.light.4.raw
cgcgtatacacacgaccggtgctcgatttagtatctgatagttgggtttgggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaacaatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactattactgtcaatctgcggacagcagtggttctcatgtggtattcggcggagggaccaagctgaccgtctaggtcagcccaaggctgccccctggtcact

SEQ ID NO: 599673 - DNA, 505 bp, Homo sapiens; identical to SEQ ID NO: 557817
  misc_feature: HIJSMM301B62DX.14.57.F02.1.454.light.4.raw

SEQ ID NO: 599674 - DNA, 499 bp, Homo sapiens
  misc_feature: HIJSMM301AI98X.3.33.C11.1.454.light.4.raw
agacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataaactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggcctgcccccc

SEQ ID NO: 599675 - DNA, 485 bp, Homo sapiens; identical to SEQ ID NO: 536695
  misc_feature: HIJSMM301CLO11.10.1.A01.1.454.light.4.raw

SEQ ID NO: 599676 - DNA, 493 bp, Homo sapiens; identical to SEQ ID NO: 536007
  misc_feature: HIJSMM301CAAQU.27.78.H01.1.454.light.4.raw

SEQ ID NO: 599677 - DNA, 460 bp, Homo sapiens; identical to SEQ ID NO: 536053
  misc_feature: HIJSMM301D897I.22.28.C06.1.454.light.4.raw

SEQ ID NO: 599678 - DNA, 492 bp, Homo sapiens
  misc_feature: HIJSMM301B5VF6.5.26.C04.1.454.light.4.raw
atcagacacgcacgaccggtgctcgatttagtctagcgactttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccacactctcctgcagggccagtcagagtgttagtggccgcttagcctggtatcagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataacgactggtggacgttcggccaagggaccaaggtggaaccaaacgaactgtggctgcaccatctgtcttcta

SEQ ID NO: 599679 - DNA, 493 bp, Homo sapiens
  misc_feature: HIJSMM301D4KW8.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcagcagtataataaatggttcctgctcactttcggcgggggaccaaggtggagatcaaacgaactgtggctgcaccatctgtt

SEQ ID NO: 599680 - DNA, 487 bp, Homo sapiens
  misc_feature: HIJSMM301DK1LJ.14.53.E09.1.454.light.4.raw
cgtctagtaccacgaccggtgctcgatttagagagagtgtgttgggtttggggggggagcctagctgtgctgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggagggaccaagctgaccgtctac

SEQ ID NO: 599681 - DNA, 500 bp, Homo sapiens
  misc_feature: HIJSMM301BVRJM.2.34.D01.1.454.light.4.raw
acgctcgacacacgaccggtgctcgatttagatcgtctgtgttgggtttgggggctttgcctgggctctgctcctcctcaccctcctcactcagggcacagggtcctgggcccagtctgccctgactcagcccccctccgcgtccgggtactcctggacagtcagtcaccatctcctgcactggaatcagcagtgacctgagtccttataactatgtctcctggtaccaacaacacccaggcaaagcccccaaactcattatttatgaagtcactaagcggccctcaggggtccctgatcgcttctctggctccaagtctggcgagacggcctccctgaccgtctctgggctccaggctgaagatgaggctgattattactgcagctcatatgcaggcagcaacaatgtggcattcggcggagggaccaagctgaccgtcctgggtcagcccaaggctgccccctcggtcactctgttcccgccctcctctgtcgagcgt

SEQ ID NO: 599682 - DNA, 484 bp, Homo sapiens; identical to SEQ ID NO: 538247
  misc_feature: HIJSMM301AHXUV.14.53.E09.1.454.light.4.raw

SEQ ID NO: 599683 - DNA, 515 bp, Homo sapiens; identical to SEQ ID NO: 538805
  misc_feature: HIJSMM301AR85I.14.19.B08.1.454.light.4.raw

SEQ ID NO: 599684 - DNA, 480 bp, Homo sapiens
  misc_feature: HIJSMM301BXWF4.16.86.H09.1.454.light.4.raw
tgtactactccacgaccggtgctcgatttagtgctatagacttgggtttgggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggccctccctgaccatctctgggctccaggctgaggacgaggctgattattattgcatctcatatacaaccaacagcactctcgactggtattcggcggaggaccaagctgaccgtcctaggtcagcccaaggctcgcccccctggtcactctcgttccccgccctcctcgagtagtaca

SEQ ID NO: 599685 - DNA, 505 bp, Homo sapiens; identical to SEQ ID NO: 574205
  misc_feature: HIJSMM301D2P98.10.88.H11.1.454.light.4.raw

SEQ ID NO: 599686 - DNA, 491 bp, Homo sapiens
  misc_feature: HIJSMM301DWXD5.9.34.D01.1.454.light.4.raw
tgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctgaggatgaggctgactattactgccatcgtatgacagtggcctaagtaacatcgtcttggaactgggaccaaggtcaccgtccg

SEQ ID NO: 599687 - DNA, 495 bp, Homo sapiens; identical to SEQ ID NO: 563808
  misc_feature: HIJSMM301DNN9X.40.57.F02.1.454.light.4.raw

SEQ ID NO: 599688 - DNA, 497 bp, Homo sapiens; identical to SEQ ID NO: 549756
  misc_feature: HIJSMM301BK09J.40.57.F02.1.454.light.4.raw

SEQ ID NO: 599689 - DNA, 484 bp, Homo sapiens; identical to SEQ ID NO: 535400
  misc_feature: HIJSMM301D9ZA1.46.26.C04.1.454.light.4.raw

SEQ ID NO: 599690 - DNA, 487 bp, Homo sapiens; identical to SEQ ID NO: 546164
  misc_feature: HIJSMM301D0XPO.5.6.A06.1.454.light.4.raw

SEQ ID NO: 599691 - DNA, 478 bp, Homo sapiens
  misc_feature: HIJSMM301AN3MY.3.33.C11.1.454.light.4.raw
agacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagaagccagggaaagcccctaacctcctgatctatgatgcctccagtttggcaagtgggtcccatcaaggttcagcggcagtggatctgggacagaattcactctcaccatcagcagcctgcagcctgatgattttgcaacttattactgccaacagtataatacccgcgtgacgttcggccaagggaccaaggtggagatcatacgaactgtggctgcacc

SEQ ID NO: 599692 - DNA, 516 bp, Homo sapiens; identical to SEQ ID NO: 552708
  misc_feature: HIJSMM301B21XU.14.19.B08.1.454.light.4.raw

SEQ ID NO: 599693 - DNA, 495 bp, Homo sapiens
  misc_feature: HIJSMM301DH99U.41.23.C01.1.454.light.4.raw
tctatactatcacgaccggtgctcgatttagtacacgtgattagggattgggggtgggtccaggaggcagaactctgggtgtctcaccatggcctggatccctctacttctccccctcctcactctctgcacaggctctgtgacctcctatgagctgacacagccaccctcggtgtcagtgtccccaggacagacggccaggatcgactgctctggagaagcattggcaacggaatatgcttattggtaccagcagaagccaggtcaggcccccatgttaataatatatagagacagtgagaggccctcggggatacctgagcgtatgtctggctccagctcagggacaacagtcacgttgaccatcactggagtccaggcagaagacgaggctgactatcactgtcaatcagcagacagtagtggttcttattgggtgttcggcggagggaccaagctgaccgtccttggtcagcccaaggctgccccctcggt

SEQ ID NO: 599694 - DNA, 505 bp, Homo sapiens
  misc_feature: HIJSMM301AFIRW.14.86.H09.1.454.light.4.raw
cgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaagagccaccctctcctgcagggccagtcagagtgttagcacctccttagcctggtaccaacagaaacctggccaggctcccagcctcctcatctctgatgcttccaacagggccactggcatcccagccaggttcagtggcagtgggtctgggacagacttcactctcaccatcagccctccctagagcctggagattttgtagtttattactgtcagcagtatagcagctggcctcccactttcggcggagggaccaaggtggagatccaacgaactgtggctgcacatctgtcttcatcttccccg

SEQ ID NO: 599695 - DNA, 484 bp, Homo sapiens
  misc_feature: HIJSMM301BTIZK.41.34.D01.1.454.light.4.raw
tctatactatcacgaccggtgctcgatttagatcgtctgtgttgggtttgggggagtcagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtcccatcaaggtttagcggcagtggatctgggacagaaattcactctcacgatcagcggcctgcagcctgatgatgtcgcaacttattactgccaacactatgatagttacccgctcactttcggcggagggaccaaggtggaggtcaagcgaactgtggctgcacca

SEQ ID NO: 599696 - DNA, 479 bp, Homo sapiens; identical to SEQ ID NO: 535188
  misc_feature: HIJSMM301B76KM.10.74.G08.1.454.light.4.raw

SEQ ID NO: 599697 - DNA, 479 bp, Homo sapiens
  misc_feature: HIJSMM301DAC8E.51.60.F05.1.454.light.4.raw
cgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacctgagcgattctctggctccacctctgggaacacagccactctgaccatcagcgggacgcaggctgtggatgaggctgacttttactgtcaggcgtgggacagcgacactgccgtgttcggcggaggccaagctgaccgtcctcggtcagcccaaggctccg

SEQ ID NO: 599698 - DNA, 520 bp, Homo sapiens; identical to SEQ ID NO: 535686
  misc_feature: HIJSMM301AM4XN.41.19.B08.1.454.light.4.raw

SEQ ID NO: 599699 - DNA, 510 bp, Homo sapiens; identical to SEQ ID NO: 538614
  misc_feature: HIJSMM301C1OSZ.19.59.F04.1.454.light.4.raw

SEQ ID NO: 599700 - DNA, 489 bp, Homo sapiens; identical to SEQ ID NO: 535139
  misc_feature: HIJSMM301C30TJ.14.55.E11.1.454.light.4.raw

SEQ ID NO: 599701 - DNA, 507 bp, Homo sapiens
  misc_feature: HIJSMM301C4I60.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccgaagggaccaaggtaggaaatacaaacgaactagtggctgcaccatctgtcttctatcttccccg

SEQ ID NO: 599702 - DNA, 485 bp, Homo sapiens
  misc_feature: HIJSMM301CQDQF.12.33.C11.1.454.light.4.raw
  modified_base (483)..(483): a, c, t, g, unknown or other
atacgacgtacacgaccggtgctcgatttagagtgagctcgttgggtttgggggcaggagtcagtctcagtcaggacacagcatggacatgagggtccccgctcagctcctggggctcctgctactctggctccgaggtgccagatgtgacatccagatgacccagtctccttcctccctgtctgcatctgtcggagacagcgtcaccatcacttgtcgggcaagtcagaacatttacaattatttaaattggtatcagcagaaaccagggaaagcccctaaactcctgatctatcatgaatccagtttgcgaagtggagtcccatcaaggttcagtggcactgggtctgagacagagttcactctcaccatcagcactctacagcctgaagattttgctaacttattattgtcaacaaagttatgagacccctgccactttcggccctgggccatagtggatatgaaacgaactgtgctgcncc

SEQ ID NO: 599703 - DNA, 512 bp, Homo sapiens
  misc_feature: HIJSMM301BPNAB.47.83.H06.1.454.light.4.raw
agctcacgtacacgaccggtgctcgatttagatcacgtgcgtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgccctcaggggtttctcatcgcttctctggctccaaatctggcaacacggcctccctgaccatctctgggctcgagtctgaggacgaggctgattacttctgttgctcttgggcaactactgtcgtttgggtgttcggcggaggaccaagttgaccgtcctaggtcagcccaaggctgccccctcggtcactctgttccccg

SEQ ID NO: 599704 - DNA, 497 bp, Homo sapiens; identical to SEQ ID NO: 535664
  misc_feature: HIJSMM301AI8WM.22.14.B03.1.454.light.4.raw

SEQ ID NO: 599705 - DNA, 502 bp, Homo sapiens; identical to SEQ ID NO: 537363
  misc_feature: HIJSMM301DCN7U.18.23.C01.1.454.light.4.raw

SEQ ID NO: 599706 - DNA, 495 bp, Homo sapiens
  misc_feature: HIJSMM301AD0TG.43.34.D01.1.454.light.4.raw
tgtgagtagtcacgaccggtgctcgatttagatcgtctgtgttgggtttgggtggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaa

SEQ ID NO: 599707 - DNA, 480 bp, Homo sapiens
  misc_feature: HIJSMM301CTKIS.4.7.A07.1.454.light.4.raw
agcactgtagcacgaccggtgctcgatttagcacgtgtcgcagggggaaaaggccctgaggaaaacaaaccccagctgggaagcctgagaacacttagccttcatgagtgtccccaccatggcctggatgatgcttctcctcggactccttgcttatggatcaggagtgaattctcagactgtggtgacccaggagccatcgttctcagtgtcccctggagggacagtcacactcacttgtgacttgagctctggctcagtctctactagttactgccccagctggtaccagcagaccccaggcctgactccacgcacgctcatctacagcacaagcgctcgctcttctggggtccctgatcgcttctctggctccatccttgggaacaagctgccctcaccatcacgggggcccaggcagatggtcagcccaaggctgccccctcggtcactctgttcccaccctcctcctacagtgct

SEQ ID NO: 599708 - DNA, 482 bp, Homo sapiens; identical to SEQ ID NO: 569533
  misc_feature: HIJSMM301EKUR7.4.1.A01.1.454.light.4.raw

SEQ ID NO: 599709 - DNA, 494 bp, Homo sapiens; identical to SEQ ID NO: 534992
  misc_feature: HIJSMM301DEPWR.9.1.A01.1.454.light.4.raw

SEQ ID NO: 599710 - DNA, 497 bp, Homo sapiens; identical to SEQ ID NO: 536371
  misc_feature: HIJSMM301EUUAE.16.78.H01.1.454.light.4.raw

SEQ ID NO: 599711 - DNA, 490 bp, Homo sapiens; identical to SEQ ID NO: 564972
  misc_feature: HIJSMM301A32X2.48.38.D05.1.454.light.4.raw

SEQ ID NO: 599712 - DNA, 508 bp, Homo sapiens; identical to SEQ ID NO: 554548
  misc_feature: HIJSMM301AV14C.17.87.H10.1.454.light.4.raw

SEQ ID NO: 599713 - DNA, 501 bp, Homo sapiens
  misc_feature: HIJSMM301EGC1U.15.83.H06.1.454.light.4.raw
tctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgcaaagtggggccccatcaaggttcagtggcagtggctctgggacagatttcactctcaccatcagcagtctccaaacctgaagattttgcaaacttacactgtcaacagagtttcagtagtccccggacgtcggtccgaaggaccgaacggtaggacgatcaaacgtaaacacgtggcgtgcaccatactgtctt

SEQ ID NO: 599714 - DNA, 499 bp, Homo sapiens
  misc_feature: HIJSMM301BJNDG.40.57.F02.1.454.light.4.raw
tctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgctgctcttatgcaggcagtttcgctctcgaagtgttcggcggagggaccgagctgaccgtcctacgtcacgcccaaggctccg

SEQ ID NO: 599715 - DNA, 492 bp, Homo sapiens
  misc_feature: HIJSMM301COSE8.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataatactggcctcggacgttcggccaaggaccgaaggtggaagtacaaacgaactgtggcgtgcaccatctgtctt

SEQ ID NO: 599716 - DNA, 493 bp, Homo sapiens; identical to SEQ ID NO: 536969
  misc_feature: HIJSMM301DZQI7.27.78.H01.1.454.light.4.raw

SEQ ID NO: 599717 - DNA, 506 bp, Homo sapiens
  misc_feature: HIJSMM301AS7M2.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaactccactgtcacttc

SEQ ID NO: 599718 - DNA, 504 bp, Homo sapiens; identical to SEQ ID NO: 566720
  misc_feature: HIJSMM301BK9TW.15.86.H09.1.454.light.4.raw

SEQ ID NO: 599719 - DNA, 487 bp, Homo sapiens
  misc_feature: HIJSMM301B0HCH.52.37.D04.1.454.light.4.raw
cgcagtacgacacgaccggtgctcgatttagtagcatactgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacgtatccctgatcgcttctcaggctccggctctgggactgagcgctacctcaccatctccagccctccagtctgaggacgagggtgactattactgtcagacgtgggacactggcagtttgggtgttcgggcggagggaccaagttgaccgtcctaggtcagcccaaggctcg

SEQ ID NO: 599720 - DNA, 509 bp, Homo sapiens
  misc_feature: HIJSMM301EI2VN.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgtcgtccacgggacgacacgtagaaatagagacgaactacgtggcgtgcgaccactctgtcttctatcttcccgt

SEQ ID NO: 599721 - DNA, 497 bp, Homo sapiens; identical to SEQ ID NO: 536376
  misc_feature: HIJSMM301EEIU7.22.9.A09.1.454.light.4.raw

SEQ ID NO: 599722 - DNA, 463 bp, Homo sapiens
  misc_feature: HIJSMM301B4H10.49.4.A04.1.454.light.4.raw
agtcgagagacacgaccggtgctcgatttagagtagtgatcagggggagtcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagatttttactttcaccatcagcaggctgcagcctgaagatattgcaacatattactgtcaacagtatgatcgcctcccgctcactttcggcgggggaccgaaggtggagatcaagcgaa

SEQ ID NO: 599723 - DNA, 512 bp, Homo sapiens; identical to SEQ ID NO: 552536
  misc_feature: HIJSMM301CDH8N.17.33.C11.1.454.light.4.raw

SEQ ID NO: 599724 - DNA, 444 bp, Homo sapiens; identical to SEQ ID NO: 535027
  misc_feature: HIJSMM301EWIUF.8.73.G07.1.454.light.4.raw

SEQ ID NO: 599725 - DNA, 483 bp, Homo sapiens
  misc_feature: HIJSMM301BLDI1.49.85.H08.1.454.light.4.raw
agtcgagagacacgaccggtgctcgatttagtatcactcagtcgcgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagaatattaataagtggttggcctggtatcagcagataccagggaaagccccctaaactcctgatctatgaggcgtctagtttagaaagtggggtcccttcaaggttcagcggcagtggatctgggacagaattcactctcaccatcaacagcctgcagcctgatgattttgcaacttattactgccaacactataatcattattctccggccactttcggccctgggaccaggctagatatcggacgaactgtgctgcaccat

SEQ ID NO: 599726 - DNA, 497 bp, Homo sapiens; identical to SEQ ID NO: 534982
  misc_feature: HIJSMM301DNUAE.26.80.H03.1.454.light.4.raw

SEQ ID NO: 599727 - DNA, 486 bp, Homo sapiens; identical to SEQ ID NO: 535043
  misc_feature: HIJSMM301DV4LA.46.35.D02.1.454.light.4.raw

SEQ ID NO: 599728 - DNA, 492 bp, Homo sapiens; identical to SEQ ID NO: 573597
  misc_feature: HIJSMM301A2IO0.10.72.G06.1.454.light.4.raw

SEQ ID NO: 599729 - DNA, 503 bp, Homo sapiens
  misc_feature: HIJSMM301EHB0C.19.10.A10.1.454.light.4.raw
tactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccgataagagtgttgacagcaccttctttgcctggtaccagcagagacctggccaggctcccaggctcctcgtttatggtgcgtccaccagggccactggcatcccccgacaggttcagtggcagtgtgtctgggacagacttcactctcaccatcagcagactggagcctgaagattttgcagtgtattactgtcaacgatatgatgagtcacctccgtggtggacatttggccaggggaccaaggttgaagtcaaacgactgtggctgcaccatctgtcttcatcttccccg

SEQ ID NO: 599730 - DNA, 510 bp, Homo sapiens
  misc_feature: HIJSMM301ERV86.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgtcgtccagggaccgacacgtagaatagagacgaactacgtggcgtgcgaccactctgtcttctactctttcccgt

SEQ ID NO: 599731 - DNA, 514 bp, Homo sapiens; identical to SEQ ID NO: 541502
  misc_feature: HIJSMM301ASDQP.15.34.D01.1.454.light.4.raw

SEQ ID NO: 599732 - DNA, 502 bp, Homo sapiens
  misc_feature: HIJSMM301EGALD.12.26.C04.1.454.light.4.raw
atacgacgtacacgaccggtgctcgatttagtctagcgactttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttattcaactccaacaatgagaactacttagcttggtaccagcagaaaccaggacagccgcccaagttgctcatttactgggcatctacccgggaatccggggtccctgaccgattcagtggcagcgggtctgagacagatttcactctcaccatcagcagcctgcaggccgaagatgtggctagtttatttttgtcagcaatattatcatactccgctcactttcggcggagggaccaaggtggagatcaaacgaactgtggctgcaccta

SEQ ID NO: 599733 - DNA, 503 bp, Homo sapiens
  misc_feature: HIJSMM301DECUF.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaactgaccgtcctaggtcagcccaagctgccccctcggtcactctcgt

SEQ ID NO: 599734 - DNA, 474 bp, Homo sapiens; identical to SEQ ID NO: 586533
  misc_feature: HIJSMM301CDQK6.7.81.H04.1.454.light.4.raw

SEQ ID NO: 599735 - DNA, 508 bp, Homo sapiens
  misc_feature: HIJSMM301DF8WV.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcgaccaagggaccaaggtggaagtcaagcgaactgtggctgcaccatctgtcttcatcttcccgcc

SEQ ID NO: 599736 - DNA, 504 bp, Homo sapiens
  misc_feature: HIJSMM301DBSIV.18.26.C04.1.454.light.4.raw
tacgagtatgcacgaccggtgctcgatttagtctagcgactttgggtttggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccgaaggtaagagatcaaaggaactagtggcgtgcacatctgtcttcatcttcccgccta

SEQ ID NO: 599737 - DNA, 524 bp, Homo sapiens
  misc_feature: HIJSMM301DR00K.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctccctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccgccctcct

SEQ ID NO: 599738 - DNA, 480 bp, Homo sapiens; identical to SEQ ID NO: 554620
  misc_feature: HIJSMM301BWWRZ.4.29.C07.1.454.light.4.raw

SEQ ID NO: 599739 - DNA, 492 bp, Homo sapiens; identical to SEQ ID NO: 536087
  misc_feature: HIJSMM301C031R.10.17.B06.1.454.light.4.raw

SEQ ID NO: 599740 - DNA, 493 bp, Homo sapiens; identical to SEQ ID NO: 536007
  misc_feature: HIJSMM301ASDLG.27.78.H01.1.454.light.4.raw

SEQ ID NO: 599741 - DNA, 501 bp, Homo sapiens; identical to SEQ ID NO: 536867
  misc_feature: HIJSMM301DZAWU.5.86.H09.1.454.light.4.raw

SEQ ID NO: 599742 - DNA, 494 bp, Homo sapiens
  misc_feature: HIJSMM301BT3PC.41.64.F09.1.454.light.4.raw
tctatactatcacgaccggtgctcgatttagcgcgtatacaagggggaggttctttctctgggatgtggcatgagcaaaactgacaagtcaaggcaggaagatgttgccatcacaactcattgggtttctgctgctctgggttccagtctccaggggtgaaattgtgctgactcaatctccagactttcagtctgtgactccaaaggagaaagtcaccatcacctgccgggccagtcagagcattggttatagcttacactggtaccagcagaaaccagatcagcctccaaagctcctcatcaagtatgcttcccagtccatctcaggggtcccctcgaggttcagtggcagtggatctgggacagatttcaccctcaccatcaatagcctggaagctgaagatgttgcaacgtattactgtcatcagagtagtactttacctcggaccttcggccaagggacacgactggagaattaacgaactgtggctgca

SEQ ID NO: 599743 - DNA, 496 bp, Homo sapiens
  misc_feature: HIJSMM301C4F4X.40.9.A09.1.454.light.4.raw
tctagcgactcacgaccggtgctcgatttagcgagacgcgcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcaccatcagcggcctgcaggctgaagatgtggcagtttattactgtcagcactgttttggcggttctccgactttcggcggagggaccaaggtggaggtcaaacgaactgtggctgcaccatctgtcttcatcttcccgccat

SEQ ID NO: 599744 - DNA, 447 bp, Homo sapiens; identical to SEQ ID NO: 535020
  misc_feature: HIJSMM301BUZFI.18.9.A09.1.454.light.4.raw

SEQ ID NO: 599745 - DNA, 479 bp, Homo sapiens; identical to SEQ ID NO: 537163
  misc_feature: HIJSMM301AZL82.13.73.G07.1.454.light.4.raw

SEQ ID NO: 599746 - DNA, 495 bp, Homo sapiens; identical to SEQ ID NO: 550605
  misc_feature: HIJSMM301B8W3Y.41.38.D05.1.454.light.4.raw

SEQ ID NO: 599747 - DNA, 496 bp, Homo sapiens; identical to SEQ ID NO: 548177
  misc_feature: HIJSMM301AQDDR.18.59.F04.1.454.light.4.raw

SEQ ID NO: 599748 - DNA, 377 bp, Homo sapiens; identical to SEQ ID NO: 536071
  misc_feature: HIJSMM301ATR4F.40.9.A09.1.454.light.4.raw

SEQ ID NO: 599749 - DNA, 497 bp, Homo sapiens
  misc_feature: HIJSMM301EHG10.52.57.F02.1.454.light.4.raw
cgcagtacgacacgaccggtgctcgatttagctcgatatagttgggtttggggagagccctggggaggaactgctcagttaggacccagagggaaccatggaagccccagctcagcttctcttcctcctgctactctggctcccagataccaccggagaagttgtattgacacagtctccagccaccctgtctttgtctccaggggggagagccaccctctcctgcagggccagtcagagtgttggcaacctcttagcctggtaccaacaaaacctggccaggctcccaggctcctcatctatgatgcatccacgagggccactggcatcccagccaggttcagtggcagtgggtctgagacagacttcactctcaccatcagtggcctcgagcctgaagattttgcagtttattactgtcagcagcgtagccactggctctctttcggcggagggaccaaggttgagatcaaacgaactgtggctgcaccatctgt

SEQ ID NO: 599750 - DNA, 492 bp, Homo sapiens
  misc_feature: HIJSMM301A9QXI.52.69.G03.1.454.light.4.raw
cgcagtacgacacgaccggtgctcgatttagtcgctgcgtaaaggagaaaggggggggtcgagtcccacgtcaggacacagcatggacatgagggtccccggcctcagctcctggggcgtcctgctgctctggctcccaggtgccagatgtgacatccagttgacccagtctccatccttcctgtctgcatctgtgggggacagagtcaccatcacttgccggaccagtgaggacatctacactagattagcctggtatcagcaagaaccggggagagccccctaaactcctgatccatactgcatccactttgcatgctggggtcccattcaggttcggcggcagtggatctgggacagaattcactctcacaatcagcagcctgcagactgaagactccgcaatttattactgtcaacaacgtcaccgttacccgatcaccttcggccaagggacacggctggagattaaacgaactgtggctgcaccat

SEQ ID NO: 599751 - DNA, 492 bp, Homo sapiens
  misc_feature: HIJSMM301AYTW3.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccggttcacttttggtccaggggaccaaactggatatcagacgaactgtggctgca

SEQ ID NO: 599752 - DNA, 503 bp, Homo sapiens
  misc_feature: HIJSMM301DP9EB.48.27.C05.1.454.light.4.raw
agtatacatacacgaccggtgctcgatttagacgcgatcgaagggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttcccg

SEQ ID NO: 599753 - DNA, 480 bp, Homo sapiens
  misc_feature: HIJSMM301A6EP4.13.73.G07.1.454.light.4.raw
tcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatgcaagcaacacaactggccgtacacttttggccaggggaccaagctggagatcaatcgaa

SEQ ID NO: 599754 - DNA, 444 bp, Homo sapiens; identical to SEQ ID NO: 535411
  misc_feature: HIJSMM301CLWJ8.8.73.G07.1.454.light.4.raw

SEQ ID NO: 599755 - DNA, 510 bp, Homo sapiens
  misc_feature: HIJSMM301CMZE9.9.55.E11.1.454.light.4.raw
tgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaaacatcattggaggtgttagtgtacactggtaccagcagaagccaggccaggcccctgtgctggtcctccatcatactagcgaccggccctcagggatccctgagcgattctcaggctccaactctgggaaaacggccaccctgaccatcagcagggtcgaagccggggatgaggccgactattactgtcaggtgtgggctggtgataatgatcatggcgggggtgttcggcggagggaccaagctgaccgtcctaagtcagcccaaggctgccccctcggtcactctccg

SEQ ID NO: 599756 - DNA, 493 bp, Homo sapiens; identical to SEQ ID NO: 537422
  misc_feature: HIJSMM301ETUY8.9.34.D01.1.454.light.4.raw

SEQ ID NO: 599757 - DNA, 497 bp, Homo sapiens; identical to SEQ ID NO: 535740
  misc_feature: HIJSMM301DED4J.3.71.G05.1.454.light.4.raw

SEQ ID NO: 599758 - DNA, 506 bp, Homo sapiens
  misc_feature: HIJSMM301D8CBL.5.86.H09.1.454.light.4.raw
atcagacacgcacgaccggtgctcgatttagtgctatagacttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgacccgtctcctgggctccagactgaggatgaggctgactattactgcagctcatttgcaggcagccgtatactcttcggcgagggaccaagctgaccgtcctaggtcagcccaaggttgccccctcggtcact

SEQ ID NO: 599759 - DNA, 504 bp, Homo sapiens
  misc_feature: HIJSMM301CLCPU.10.9.A09.1.454.light.4.raw
catagtagtgcacgaccggtgctcgatttagcgagacgcgcaggggcagagccctggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggccccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggccgtccggggccacttcggccctgggaccaagtggagatcaaacgaactagtggctgcacctac

SEQ ID NO: 599760 - DNA, 502 bp, Homo sapiens
  misc_feature: HIJSMM301A21TR.43.37.D04.1.454.light.4.raw
tgtgagtagtcacgaccggtgctcgatttagtagcatactgttgggtttgggggtgggtagagaagacaggactcaggacaatctccagcatggccagcttccctctcctcctcaccctcctcactcactgtgcagggtcctgggcccagtctgtggtgactcagccaccctcagcgtctgggacccccggacagagggtcagcatctcctgttctggaagcagctccaacattggacgtaatactgtaaactggtaccagcaactcgcaggaacggcccccaaactcctcatctatgaccatcatcagcggccctcaggggtccctgaccgattctctggctccaagtctggctcttcagcctccctggccatcagtgggctccagtctgaggatgaggctgattattactgtgcagcgtgggatgacagcctgaatgcttgggtgttcggcggagggaccaaggtgaccgtctaggtcagcccaaggctgccccctcggt

SEQ ID NO: 599761 - DNA, 495 bp, Homo sapiens; identical to SEQ ID NO: 535007
  misc_feature: HIJSMM301EHT2Z.22.5.A05.1.454.light.4.raw

SEQ ID NO: 599762 - DNA, 493 bp, Homo sapiens; identical to SEQ ID NO: 537180
  misc_feature: HIJSMM301DIGT1.4.27.C05.1.454.light.4.raw

SEQ ID NO: 599763 - DNA, 518 bp, Homo sapiens
  misc_feature: HIJSMM301DEF07.10.38.D05.1.454.light.4.raw
  modified_base (514)..(514): a, c, t, g, unknown or other
catagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttggcggcgggactaaggtgaccgtcctgggtcagcccaaggctgccccctcggtcactctgttcccnccct

SEQ ID NO: 599764 - DNA, 513 bp, Homo sapiens; identical to SEQ ID NO: 573254
  misc_feature: HIJSMM301EOMR4.48.81.H04.1.454.light.4.raw

SEQ ID NO: 599765 - DNA, 488 bp, Homo sapiens
  misc_feature: HIJSMM301BNN3N.51.83.H06.1.454.light.4.raw
cgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcaatttattactgtcagcagcgtagcaattggcctccctcgatcaccttcggccaagggacacgactggagaataaacgaactgtggctgcaccat

SEQ ID NO: 599766 - DNA, 481 bp, Homo sapiens
  misc_feature: HIJSMM301AKJS7.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgaagattttgcagtttattactgtcagcactataataactggcctccgtacagttttggccgaggggaccaagctggagatcaaacgaa

SEQ ID NO: 599767 - DNA, 499 bp, Homo sapiens
  misc_feature: HIJSMM301B1KGI.10.27.C05.1.454.light.4.raw
catagtagtgcacgaccggtgctcgatttagacgcgatcgaagggtttgggggctggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgcctctttcaaggttttcggcggagggaccaggctgaccgtcctaagtcagcccaaggctg

SEQ ID NO: 599768 - DNA, 497 bp, Homo sapiens; identical to SEQ ID NO: 536376
  misc_feature: HIJSMM301ADJ3P.22.9.A09.1.454.light.4.raw

SEQ ID NO: 599769 - DNA, 501 bp, Homo sapiens; identical to SEQ ID NO: 536818
  misc_feature: HIJSMM301D9B7K.12.82.H05.1.454.light.4.raw

SEQ ID NO: 599770 - DNA, 478 bp, Homo sapiens; identical to SEQ ID NO: 541928
  misc_feature: HIJSMM301CIZ69.7.76.G10.1.454.light.4.raw

SEQ ID NO: 599771 - DNA, 486 bp, Homo sapiens
  misc_feature: HIJSMM301C3W9P.41.78.H01.1.454.light.4.raw
tctatactatcacgaccggtgctcgatttagtgtgagtagtttgggtttgggggatcaggacttctcagttcatcttctcaccatgaggctccctgctcagctcctggggctgctaatgctctggatacctggatccagtgcagatattgtgatgtcccagactccactctctctgtccgtcacccctggacagccggcctccatctcctgcaagtctagtcagagtctcctccatgagaatggacaaaacttatttctactggtacctacagaaggcaggccagccgccacagctcctgatctatgaggttttcaggtcggttctctggagtgccagacaggttcagtggcagcgggtccgggacagatttcacactgaggatcagtcgggtggaggctgacgacgttgggacttattactgcgcgcaaagtctacaccttcctctcactttcgggccctgggaccaaagtggacatcaaacgaa

SEQ ID NO: 599772 - DNA, 516 bp, Homo sapiens
  misc_feature: HIJSMM301AT699.13.55.E11.1.454.light.4.raw
tcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcaccatcacttgccgggcaagtcagagcattaccaactatttgaattggtatcaacaaaaaccagggagagcccctcaccctccttatctatggtgcatccaccttacaaagtggggtcccatcaaggttcagtggcactggatctgggacagatttcactctcaccatcagcagtctgcaacctgaagattttgcaacttattactgtcaaacagagtttcagtacgcggacgttcggtccgaacggaccgaaggtaggaaagtacaaacgaaacctagtggtcgtgcaccaactctcgtcttctatcttccccg

SEQ ID NO: 599773 - DNA, 496 bp, Homo sapiens; identical to SEQ ID NO: 536248
  misc_feature: HIJSMM301A1ZQP.22.27.C05.1.454.light.4.raw

SEQ ID NO: 599774 - DNA, 446 bp, Homo sapiens
  misc_feature: HIJSMM301BX6HG.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctcgccccctcggtcactctgttcccgccctcctccgacacgcgag

SEQ ID NO: 599775 - DNA, 518 bp, Homo sapiens
  misc_feature: HIJSMM301AHR87.19.80.H03.1.454.light.4.raw
  modified_base (506)..(506): a, c, t, g, unknown or other
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgccaatggttgcaccgcaaagcggggacccagaccctggagcctcagttggaagcagccgatccagcctgcggagcctgtggggcaggtcagcccaaggctcgccccctcggtcactctgttcccnccctcctccacg

SEQ ID NO: 599776 - DNA, 480 bp, Homo sapiens
  misc_feature: HIJSMM301EE0EX.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagattttgcaacttactattgtcaacaggctaacagtttcccgctcaccttcggcgggggaccgaaggtggagatacaacgaactcgtggctgcacc

SEQ ID NO: 599777 - DNA, 508 bp, Homo sapiens; identical to SEQ ID NO: 578410
  misc_feature: HIJSMM301CSLJ8.19.72.G06.1.454.light.4.raw

SEQ ID NO: 599778 - DNA, 443 bp, Homo sapiens; identical to SEQ ID NO: 559200
  misc_feature: HIJSMM301DFOIH.5.9.A09.1.454.light.4.raw

SEQ ID NO: 599779 - DNA, 503 bp, Homo sapiens
  misc_feature: HIJSMM301EHQ6W.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccattggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaagtggatatcaaacgaactgtggctgcaccatctgtt

SEQ ID NO: 599780 - DNA, 415 bp, Homo sapiens; identical to SEQ ID NO: 536113
  misc_feature: HIJSMM301CZNBF.18.78.H01.1.454.light.4.raw

SEQ ID NO: 599781 - DNA, 496 bp, Homo sapiens; identical to SEQ ID NO: 535109
  misc_feature: HIJSMM301B87I9.16.78.H01.1.454.light.4.raw

SEQ ID NO: 599782 - DNA, 509 bp, Homo sapiens
  misc_feature: HIJSMM301BEZT1.51.57.F02.1.454.light.4.raw
cgatcgtatacacgaccggtgctcgatttagctcgatatagttggggtttgggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcatatacaatcaataacaattgggtgttcggcggagggaccaaactgaccgtcctaggtcagcccaaggctgccccctcggtcact

SEQ ID NO: 599783 - DNA, 502 bp, Homo sapiens; identical to SEQ ID NO: 543936
  misc_feature: HIJSMM301A6C4J.15.1.A01.1.454.light.4.raw

SEQ ID NO: 599784 - DNA, 536 bp, Homo sapiens
  misc_feature: HIJSMM301CECJW.43.19.B08.1.454.light.4.raw
tgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcagtccggttcgttcggcgggacgggaccgtaagttcggacccgtacctaagtcgacgacccgaacggctccgccccctcggtccactcttcgttccccaccctcctccta

SEQ ID NO: 599785 - DNA, 486 bp, Homo sapiens; identical to SEQ ID NO: 535043
  misc_feature: HIJSMM301AJIBB.46.35.D02.1.454.light.4.raw

SEQ ID NO: 599786 - DNA, 505 bp, Homo sapiens; identical to SEQ ID NO: 535987
  misc_feature: HIJSMM301DK4BX.18.37.D04.1.454.light.4.raw

SEQ ID NO: 599787 - DNA, 482 bp, Homo sapiens
  misc_feature: HIJSMM301AKJDP.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatgggacaccggcctccagtgcggtgggttttcgggcggagggaccaagctgaccgtcctacggtca

SEQ ID NO: 599788 - DNA, 486 bp, Homo sapiens
  misc_feature: HIJSMM301BIIRS.17.57.F02.1.454.light.4.raw
  modified_base (461)..(461): a, c, t, g, unknown or other
cgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagcaacttttttaaattggtatcagcgggaaccagggaaagcccctaaactcctgatctatactgcatccaatttgcaaagtgggtccatcaaggttcagtggcagtggatctgggacagatttcactctcaccatcagcagtctgcaacctgagattttgcaacttactactgtcaacagggttacagtaccccgtacacttttggccaggggaccaagctgganatcaaacgaactgtggctgcaccat

SEQ ID NO: 599789 - DNA, 480 bp, Homo sapiens; identical to SEQ ID NO: 581458
  misc_feature: HIJSMM301ASLSM.21.25.C03.1.454.light.4.raw

SEQ ID NO: 599790 - DNA, 486 bp, Homo sapiens; identical to SEQ ID NO: 562254
  misc_feature: HIJSMM301AK3H0.49.38.D05.1.454.light.4.raw

SEQ ID NO: 599791 - DNA, 497 bp, Homo sapiens; identical to SEQ ID NO: 536371
  misc_feature: HIJSMM301A978N.16.78.H01.1.454.light.4.raw

SEQ ID NO: 599792 - DNA, 498 bp, Homo sapiens
  misc_feature: HIJSMM301EBLC4.10.20.B09.1.454.light.4.raw
  modified_base (286)..(286): a, c, t, g, unknown or other
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcaccctntctggtgcatcttcgagggccactggtgtcccagccaggttcagtggcagtgggtctggaacagagttcactctcaccatcagcggcctgcagtctgaagattttgcagtttattactgtcagcagtataatgactgggttttattctactttcggccctgggaccaaaggtggatttcagacgaactggtggctgcaccatctgtcttcta

SEQ ID NO: 599793 - DNA, 500 bp, Homo sapiens
  misc_feature: HIJSMM301DDSRD.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggaggaccaaactgaccgtctaggtcagcccaaggctgccccctc

SEQ ID NO: 599794 - DNA, 495 bp, Homo sapiens; identical to SEQ ID NO: 536931
  misc_feature: HIJSMM301ETZAT.10.33.C11.1.454.light.4.raw

SEQ ID NO: 599795 - DNA, 518 bp, Homo sapiens
  misc_feature: HIJSMM301B6UNY.47.53.E09.1.454.light.4.raw
agctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcggggatgaggccgtatatttttgtcaggtgtggagactaattttggtcatatgttgttcggcggagggaccgaagctgaccgtcctcggtcagcccaaggctgccccctccggtcactctgttcccaccctcct

SEQ ID NO: 599796 - DNA, 501 bp, Homo sapiens
  misc_feature: HIJSMM301CTST1.48.85.H08.1.454.light.4.raw
agtatacatacacgaccggtgctcgatttagtatcactcagtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgagttttcggcggggggaccaggctgaccgtcggcggtcagcccaaggctgccccctcggtcactctcgtcccg

SEQ ID NO: 599797 - DNA, 504 bp, Homo sapiens
  misc_feature: HIJSMM301BMEOB.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggagatcaaacgaactgtgctgcaccatctgtcttcatcttcccgccat

SEQ ID NO: 599798 - DNA, 495 bp, Homo sapiens; identical to SEQ ID NO: 539836
  misc_feature: HIJSMM301E0FYA.9.1.A01.1.454.light.4.raw

SEQ ID NO: 599799 - DNA, 500 bp, Homo sapiens
  misc_feature: HIJSMM301B8HP5.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactggggctcaggcggaagatgaggctgactattactgtaactccgggacagcagtgctgaccaggtggtattcggcggagggacccacctgaccgtcttaggtcagcccaaggctgcccctcggtcac

SEQ ID NO: 599800 - DNA, 470 bp, Homo sapiens; identical to SEQ ID NO: 535302
  misc_feature: HIJSMM301DY3BR.13.76.G10.1.454.light.4.raw

SEQ ID NO: 599801 - DNA, 483 bp, Homo sapiens
  misc_feature: HIJSMM301CJMFH.40.83.H06.1.454.light.4.raw
tctagcgactcacgaccggtgctcgatttagatcacgtgcgtcgcggggcaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatggtgttcggcggagggaccaaactgtccgtcctaggtcagcccg

SEQ ID NO: 599802 - DNA, 481 bp, Homo sapiens
  misc_feature: HIJSMM301BHMUP.5.70.G04.1.454.light.4.raw
atcagacacgcacgaccggtgctcgatttagtgtagtgtgaagggaaaggggggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctgaagattttgcaacttacttttgtcaacaggctcagagtttcccgcttcactttcggcggagggaccaaggtggagatcaaacgactagtggctgca

SEQ ID NO: 599803 - DNA, 492 bp, Homo sapiens; identical to SEQ ID NO: 561126
  misc_feature: HIJSMM301C2B0Z.43.29.C07.1.454.light.4.raw

SEQ ID NO: 599804 - DNA, 485 bp, Homo sapiens; identical to SEQ ID NO: 536075
  misc_feature: HIJSMM301EWBOY.17.21.B10.1.454.light.4.raw

SEQ ID NO: 599805 - DNA, 499 bp, Homo sapiens; identical to SEQ ID NO: 572730
  misc_feature: HIJSMM301DWUAK.3.71.G05.1.454.light.4.raw

SEQ ID NO: 599806 - DNA, 482 bp, Homo sapiens
  misc_feature: HIJSMM301C915M.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaaccttcggccaggggacacgactggagattaaacgaactgtggctgcaccatc

SEQ ID NO: 599807 - DNA, 444 bp, Homo sapiens; identical to SEQ ID NO: 536685
  misc_feature: HIJSMM301AN39T.10.76.G10.1.454.light.4.raw

SEQ ID NO: 599808 - DNA, 491 bp, Homo sapiens; identical to SEQ ID NO: 535294
  misc_feature: HIJSMM301BV7U9.16.68.G02.1.454.light.4.raw

SEQ ID NO: 599809 - DNA, 464 bp, Homo sapiens; identical to SEQ ID NO: 578064
  misc_feature: HIJSMM301D1D53.11.70.G04.1.454.light.4.raw

SEQ ID NO: 599810 - DNA, 492 bp, Homo sapiens; identical to SEQ ID NO: 543452
  misc_feature: HIJSMM301DT5RA.3.72.G06.1.454.light.4.raw

SEQ ID NO: 599811 - DNA, 521 bp, Homo sapiens
  misc_feature: HIJSMM301CN2P1.12.71.G05.1.454.light.4.raw
atacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggatgaggctgattattactgcagctcatatggaggttatagcacgttgggtgttcggcggcgggaccaaaggtgaccgtcctaagtcagcccaaggctcgccccctcggtccactctgttcccg

SEQ ID NO: 599812 - DNA, 501 bp, Homo sapiens
  misc_feature: HIJSMM301BS8A0.12.86.H09.1.454.light.4.raw
atacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgaagattttgcagtttattactgtcagcagcgtagcaactggcctcggttcacttttggccaggggaccaagctggagatcaaacgaactgtggctgcaccatctgtcttcattcc

SEQ ID NO: 599813 - DNA, 519 bp, Homo sapiens
  misc_feature: HIJSMM301DLSKB.14.70.G04.1.454.light.4.raw
  modified_base (508)..(508): a, c, t, g, unknown or other
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggacgcctcagttggaagcagccgatccagcctgcggagcctgtggggcaggtcagcccaaggccaacccacngtcactctccg

SEQ ID NO: 599814 - DNA, 502 bp, Homo sapiens
  misc_feature: HIJSMM301ASACJ.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgacccatctctgggctccaggctgatgacgaggctgattattactgcaggtcatatacaatcagcaacacttatgtcttcgggactgggaccaagatcacgtcctaggtcagcccaaggccaaccccactgtca

SEQ ID NO: 599815 - DNA, 512 bp, Homo sapiens
  misc_feature: HIJSMM301DP8DJ.4.21.B10.1.454.light.4.raw
agcactgtagcacgaccggtgctcgatttagtgtcgtcgcaagagagagagaggaggggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaactgaccgtcctaggtcacgcccaaggctcgccccctcggtccacttccg

SEQ ID NO: 599816 - DNA, 488 bp, Homo sapiens; identical to SEQ ID NO: 537260
  misc_feature: HIJSMM301CO1GT.47.70.G04.1.454.light.4.raw

SEQ ID NO: 599817 - DNA, 537 bp, Homo sapiens
  misc_feature: HIJSMM301ETCL7.14.57.F02.1.454.light.4.raw
cgtctagtaccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcacaggcttacagaacgctcccctacccaacaacgcataagcgtcgctgccgcagcttcggtgcatggtttagcccgttacatcttcccgccat

SEQ ID NO: 599818 - DNA, 501 bp, Homo sapiens
  misc_feature: HIJSMM301EG0H0.3.79.H02.1.454.light.4.raw
agacgcactccacgaccggtgctcgatttagtgtcacacgaagggaaaggggggggtcgtcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaagcccccaaactcatcatttatgatgtcactgctcggccctcaggggtttctcatcgcttttctggctcaagtctggcaccacggcctccctgaccatctcgggctccaggctgaggacgaggctgcttattactgcagctcatatacaaggagcaccactctcgtggtagtttggtggagggaccaagctgaccgtcctaggtcagccaaggctcgcccc

SEQ ID NO: 599819 - DNA, 489 bp, Homo sapiens
  misc_feature: HIJSMM301CR1MG.49.20.B09.1.454.light.4.raw
agtcgagagacacgaccggtgctcgatttagtgtagtgtgaagggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacaatatgcttactggtaccagcagaggccaggccaggcccctgtcttggtgatttataaagactttgagaggccctcagggacccctgagcgattctctggctccagctcagggacaacagtcaccttgaccatcagtggagtccggccagaggacgaggctgactattactgtcagtccgcagacagcagtgcagttatgtcgtattcggcggagggactacgctgaccgtcctaggtcagccaaggctcgcccctcggtcactctccg

SEQ ID NO: 599820 - DNA, 470 bp, Homo sapiens
  misc_feature: HIJSMM301B311T.15.81.H04.1.454.light.4.raw
tctacgtagccacgaccggtgctcgatttagtagtgtagattcgcgggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggaggaccaagctgaccgtcctaggtcagcccaaggctgcccctcggtcactctgttcccgccttcctcgctacgtga

SEQ ID NO: 599821 - DNA, 517 bp, Homo sapiens
  misc_feature: HIJSMM301DRST6.10.38.D05.1.454.light.4.raw
catagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttggcggcgggactaaggtgaccgtctgggtcagcccaaggctgccccctcggtcactctgttcccgccct

SEQ ID NO: 599822 - DNA, 472 bp, Homo sapiens; identical to SEQ ID NO: 536302
  misc_feature: HIJSMM301AKVGA.18.76.G10.1.454.light.4.raw

SEQ ID NO: 599823 - DNA, 476 bp, Homo sapiens; identical to SEQ ID NO: 537368
  misc_feature: HIJSMM301EL25Z.7.83.H06.1.454.light.4.raw

SEQ ID NO: 599824 - DNA, 447 bp, Homo sapiens; identical to SEQ ID NO: 535201
  misc_feature: HIJSMM301CNJ2D.18.9.A09.1.454.light.4.raw

SEQ ID NO: 599825 - DNA, 482 bp, Homo sapiens
  misc_feature: HIJSMM301DRZC5.19.71.G05.1.454.light.4.raw
tactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagccagcctgcaggctgaagatgtggcagtttattattgtcaacaatattattatacttcgtggacgttcggcaagggaccaaggtggatatcagacgaa

SEQ ID NO: 599826 - DNA, 505 bp, Homo sapiens
  misc_feature: HIJSMM301ED6D9.19.85.H08.1.454.light.4.raw
tactctcgtgcacgaccggtgctcgatttagtatcactcagtcgcggggtccaaacgagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacacgtcacctgcaccgggaacaccaacaatgtcggcgaccagggagccgcttggctgcagcaacgccagggccaccctcccaaactcctgtcgtacaggaactgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggaggaccaagctgaccgtctgggtcagcccaaggctgccccctcggtca

SEQ ID NO: 599827 - DNA, 502 bp, Homo sapiens
  misc_feature: HIJSMM301AK2FH.12.48.E04.1.454.light.4.raw
atacgacgtacacgaccggtgctcgatttagagagcgtcacagagagaaggggagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggagccggccccccgactcctcatctttaataacaatcagcggccctcaggggtccctgaccgattctctggctccaagtctggcacctcagcctccctggccatcagtgggctccagtctgaggatgaggctgatttattactgtgcatcatgggctgaccaccctgactggtccgggagtgttcggcggagggaccaagctgaccgtcctaggtcagccc

SEQ ID NO: 599828 - DNA, 495 bp, Homo sapiens; identical to SEQ ID NO: 535596
  misc_feature: HIJSMM301DBC9N.10.79.H02.1.454.light.4.raw

SEQ ID NO: 599829 - DNA, 480 bp, Homo sapiens; identical to SEQ ID NO: 547848
  misc_feature: HIJSMM301CAZUT.7.83.H06.1.454.light.4.raw

SEQ ID NO: 599830 - DNA, 500 bp, Homo sapiens; identical to SEQ ID NO: 539362
  misc_feature: HIJSMM301AUORV.26.26.C04.1.454.light.4.raw

SEQ ID NO: 599831 - DNA, 488 bp, Homo sapiens
  misc_feature: HIJSMM301ESXKY.17.25.C03.1.454.light.4.raw
cgtagactagcacgaccggtgctcgatttagtagtgtagatttgggtttggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacagttcccctcgcacttttggccaggggaccaaagttgagatcaaacgaactgtggctgcaccatctgtt

SEQ ID NO: 599832 - DNA, 486 bp, Homo sapiens; identical to SEQ ID NO: 537840
  misc_feature: HIJSMM301CR93J.40.81.H04.1.454.light.4.raw

SEQ ID NO: 599833 - DNA, 504 bp, Homo sapiens
  misc_feature: HIJSMM301A5ICA.10.12.B01.1.454.light.4.raw
catagtagtgcacgaccggtgctcgatttagtagtgtagattccgcgggggtgggtccaggaggcagaactctgggtgtctcaccatggcctggatccctctacttctccccctcctcactctctgcacagggtccgaggcctcctatgagctgacacagccaccctcggtgtcagtgtccccaggacagacggccaggatcacctgctctggagatgctttgccgaagcaatatgcttactggtaccagcagaagccaggccaggcccctgtggaacttgtatataaggacactgagaggcccccagggatccctgagcgattctctggctccagctcagggacaacagtgacgttgaccatcagcggagcccgggcagaggacgaggctgactattactgtcaatcacaagacattactggtacttattgggtgttcggcgagggtccaagctgaccgtcctaggtcagcccaaggctgccccctcggtcactctgttccca

SEQ ID NO: 599834 - DNA, 489 bp, Homo sapiens; identical to SEQ ID NO: 535139
  misc_feature: HIJSMM301AU63D.14.55.E11.1.454.light.4.raw

SEQ ID NO: 599835 - DNA, 524 bp, Homo sapiens
  misc_feature: HIJSMM301CA03V.40.27.C05.1.454.light.4.raw
tctagcgactcacgaccggtgctcgatttagacgcgatcgaagggtttggggggagaagacaggattcaggccaatctccagcatggccggcttccctctcctcctcaccctcctcactcactgtgcagggtcctgggcccagtctgtgctgactcagccaccctcagcgtctgagacccccgggcagcaggttaccgtctcttgttctggaagcagctccaacatcggaagtaattctgtatactggtaccagtgcctcccaggaacggcccccaaacttctcgtctatagggattatcagcggcccttaggggtccctgaccgattctctggctccaggtctggcacctcagcctccctggccatcagtgggctccggcccgaggatgaggcggattattattgtgtgtcatgggatgacagaatgaatggtccggtgttcggcggagggaccaggctgaccgtcctaggtcagcccaaggctgccccctcggtcactctgttcccaccctcctcagtcgct

SEQ ID NO: 599836 - DNA, 486 bp, Homo sapiens; identical to SEQ ID NO: 537840
  misc_feature: HIJSMM301DSAX6.40.81.H04.1.454.light.4.raw

SEQ ID NO: 599837 - DNA, 495 bp, Homo sapiens; identical to SEQ ID NO: 536359
  misc_feature: HIJSMM301CI4Q7.48.4.A04.1.454.light.4.raw

SEQ ID NO: 599838 - DNA, 502 bp, Homo sapiens
  misc_feature: HIJSMM301ESN5I.17.28.C06.1.454.light.4.raw
cgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtctaagtcagcccaaggctg

SEQ ID NO: 599839 - DNA, 498 bp, Homo sapiens; identical to SEQ ID NO: 536879
  misc_feature: HIJSMM301CM7JN.22.14.B03.1.454.light.4.raw

SEQ ID NO: 599840 - DNA, 488 bp, Homo sapiens; identical to SEQ ID NO: 535861
  misc_feature: HIJSMM301DLMCK.14.55.E11.1.454.light.4.raw

SEQ ID NO: 599841 - DNA, 490 bp, Homo sapiens; identical to SEQ ID NO: 535234
  misc_feature: HIJSMM301A39SW.17.21.B10.1.454.light.4.raw

SEQ ID NO: 599842 - DNA, 495 bp, Homo sapiens; identical to SEQ ID NO: 538277
  misc_feature: HIJSMM301AXXNV.16.53.E09.1.454.light.4.raw

SEQ ID NO: 599843 - DNA, 510 bp, Homo sapiens
  misc_feature: HIJSMM301EMQJ3.10.39.D06.1.454.light.4.raw
catagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggccccaggacagacggccacgctgacctggtgggggatacacaattggaagtaatcgtgtgcactggtaccagcagaggccaggccaggcccctgtggttgtcgtctataatgataacgaccggccctcagggatccctgagcgattctctggctccaattcgggcaacacggccaccctcatcatcaccagggtcgagggccggggatgaggccgactactactgtcaggtgtgggatttcactactgatcatggtgggggtcttcggcggagggaccaagctgaccgtcctaagtcacgcccaaggctcgccccctcggtcta

SEQ ID NO: 599844 - DNA, 486 bp, Homo sapiens; identical to SEQ ID NO: 535043
  misc_feature: HIJSMM301BC9P2.46.35.D02.1.454.light.4.raw

SEQ ID NO: 599845 - DNA, 489 bp, Homo sapiens
  misc_feature: HIJSMM301BR60G.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagatttttgctaacttactactgtcaacagagttacacgtaccccctcacttcggcggagggacgaaggcgagatcagacgaactgtggctgcaccatctgtcttcta

SEQ ID NO: 599846 - DNA, 450 bp, Homo sapiens
  misc_feature: HIJSMM301CVRAH.18.9.A09.1.454.light.4.raw
tacgagtatgcacgaccggtgctcgatttagcgagacgcgcagggtccgtgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactagttactgccagtcctatgacatgaggctgagtggttcgtatgtcttcggatctgggaccaaggtcaccgtcctaagtcagcccaaggccaacccctctgtcacttctgttcccgccctcctccatactcgta

SEQ ID NO: 599847 - DNA, 512 bp, Homo sapiens
  misc_feature: HIJSMM301D9TSR.52.38.D05.1.454.light.4.raw
cgcagtacgacacgaccggtgctcgatttagtatctgatagttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttatgactttgtctcctggtaccaacaccaccctggcaaagcccccaaactcatcatttttgaggtcactaagcggccctcaggggtccctgatcgcttctctggctcgaagtctggcaacacggcctcctgaccgtctctgggctccaggctgaggatgaggctgattactactgcacctcatatgcaggcgacaacaagttttgggggtttcgcggagggaccaaggtgaccgtcctacgtcagcccaaggctgccccctggtcact

SEQ ID NO: 599848 - DNA, 467 bp, Homo sapiens; identical to SEQ ID NO: 573030
  misc_feature: HIJSMM301CDGDJ.11.70.G04.1.454.light.4.raw

SEQ ID NO: 599849 - DNA, 494 bp, Homo sapiens
  misc_feature: HIJSMM301A8Q2K.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggactttcggccctgggaccaaagtggagatcaacgaaactgtggctgcaccatctgtctt

SEQ ID NO: 599850 - DNA, 514 bp, Homo sapiens; identical to SEQ ID NO: 540552
  misc_feature: HIJSMM301DZR3D.16.66.F11.1.454.light.4.raw

SEQ ID NO: 599851 - DNA, 479 bp, Homo sapiens; identical to SEQ ID NO: 535118
  misc_feature: HIJSMM301BVS7H.13.59.F04.1.454.light.4.raw

SEQ ID NO: 599852 - DNA, 477 bp, Homo sapiens
  misc_feature: HIJSMM301CG54X.48.56.F01.1.454.light.4.raw
  modified_base (390)..(390): a, c, t, g, unknown or other
agtatacatacacgaccggtgctcgatttagcagacgtctgaacacacaaagggggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcgcttgccgggcaagtcaggacattaaaagtgatttaggctggtatcagcagaaaccagggaaagcccctaagctcctgatctatgctgcatccactttacaaagtggagtcccatcaaggttcagcggcagtggatctggcacagatttcactctcaccatcagcagcctgcagcctgaanattctgcaacttaattactgtctaaccagtattacaattacctcgtacgttcggccaacggaccgaaggtaggaaatacaaacgaaa

SEQ ID NO: 599853 - DNA, 513 bp, Homo sapiens
  misc_feature: HIJSMM301E1454.17.33.C11.1.454.light.4.raw
cgtagactagcacgaccggtgctcgatttagagtgagctcgttgggtttgggggcgccagggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccgccctcct

SEQ ID NO: 599854 - DNA, 492 bp, Homo sapiens; identical to SEQ ID NO: 534967
  misc_feature: HIJSMM301AKR18.47.64.F09.1.454.light.4.raw

SEQ ID NO: 599855 - DNA, 487 bp, Homo sapiens
  misc_feature: HIJSMM301BPOMQ.19.71.G05.1.454.light.4.raw
tactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttggccaagggaccaaggtggatatcagacgaa

SEQ ID NO: 599856 - DNA, 517 bp, Homo sapiens; identical to SEQ ID NO: 548781
  misc_feature: HIJSMM301ES3L7.19.80.H03.1.454.light.4.raw

SEQ ID NO: 599857 - DNA, 490 bp, Homo sapiens
  misc_feature: HIJSMM301A41ZW.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatacgaactgcaagtccagccacaatcttttatacagttccaacaatgaaaactacttagcttggtaccagcagagaccaggacagcctcctaggctgctcatttactgggcatcctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 599858 - DNA, 513 bp, Homo sapiens
  misc_feature: HIJSMM301BGH7A.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctcctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccaccctcct

SEQ ID NO: 599859 - DNA, 502 bp, Homo sapiens
  misc_feature: HIJSMM301AVERS.4.6.A06.1.454.light.4.raw
agcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtctggggcccccgggcagagggtcatcctctcttgttctggaggcagctccaacatcggaggacatcctgtgagctggtaccaacacctcccaggaacggcccccaaactcctcatctatacagattctaagaggcccgcaggggtcccagatcgattctctggctccaggtctggcacctcagcctccctgtccatcagtggactccggtctgaggatgaggctgactactattgttcaggatgggattacagcctacatgctcggctgttcggcggagggacaaactgaccgtcttaggtcagcccaaggctgtccccccg

SEQ ID NO: 599860 - DNA, 499 bp, Homo sapiens; identical to SEQ ID NO: 586350
  misc_feature: HIJSMM301B0OQZ.2.34.D01.1.454.light.4.raw

SEQ ID NO: 599861 - DNA, 504 bp, Homo sapiens
  misc_feature: HIJSMM301EBDKP.40.33.C11.1.454.light.4.raw
tctagcgactcacgaccggtgctcgatttagagtgagctcgttgggtttggggggaagcctgagaacacttagccttcatgagtgtccccacccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatgtggggggtgccacttgggtgttcggcggagggaccaagctgaccgtcctaggtcagcccaaggctgccccctc

SEQ ID NO: 599862 - DNA, 484 bp, Homo sapiens; identical to SEQ ID NO: 541039
  misc_feature: HIJSMM301BKVCP.46.35.D02.1.454.light.4.raw

SEQ ID NO: 599863 - DNA, 496 bp, Homo sapiens; identical to SEQ ID NO: 541772
  misc_feature: HIJSMM301EF6DX.51.81.H04.1.454.light.4.raw

SEQ ID NO: 599864 - DNA, 485 bp, Homo sapiens
  misc_feature: HIJSMM301DU9ZB.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatcgtggaccagggtcaccgtcctaggtcagcccaaggccaa

SEQ ID NO: 599865 - DNA, 507 bp, Homo sapiens
  misc_feature: HIJSMM301CEH5U.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagcccaaggctcgccccctcggtccta

SEQ ID NO: 599866 - DNA, 514 bp, Homo sapiens; identical to SEQ ID NO: 543870
  misc_feature: HIJSMM301ASEWF.40.12.B01.1.454.light.4.raw

SEQ ID NO: 599867 - DNA, 475 bp, Homo sapiens
  misc_feature: HIJSMM301COPRT.51.76.G10.1.454.light.4.raw
cgatcgtatacacgaccggtgctcgatttagtcactcatacaggggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgaagattttgcaatttattactgtcagcagtataataactggcctccgtacacttttggccaggggaccaagctggagatcaacgaactgtggctgcacc

SEQ ID NO: 599868 - DNA, 512 bp, Homo sapiens
  misc_feature: HIJSMM301DMBIF.41.30.C08.1.454.light.4.raw
tctatactatcacgaccggtgctcgatttagtctgacgtcaaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgattaccatctcctgctctgggatcaacagcgaccttggtggttataactatgtgtcctggtaccaacaatatccaggcaaacccccaaagtcatcatttatgatgtcggtagtcggccctccggggtctctagtcgcttctctggctccaagtctggcaacacggcctccctgaccatctctgggctccaggctgaggacgaggctgactattactgcagttcatatacaagcagcagcactggagtcttcggaactgggaccagggtcaccgtcctaggtcagcccaaggccaacccccactgtcactctgtt

SEQ ID NO: 599869 - DNA, 494 bp, Homo sapiens
  misc_feature: HIJSMM301C8MQG.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctaccgggaatccggggtccctgaccgattcagtggcagcgggtctgggacagatttcactctcaccatcagcagcctgcaggctgaagatgtggcagtttatattgtcagcaatattatattcctcctcagacgttcggccaagggaccaaggtggaaatcaaacgaactgtggctgcacc

SEQ ID NO: 599870 - DNA, 498 bp, Homo sapiens; identical to SEQ ID NO: 553891
  misc_feature: HIJSMM301AX4TI.3.33.C11.1.454.light.4.raw

SEQ ID NO: 599871 - DNA, 489 bp, Homo sapiens
  misc_feature: HIJSMM301CJ3GM.11.12.B01.1.454.light.4.raw
cgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaataccaggcggccctctggggtccctgagcgattctccggctccggctctgggaacacagtcactctgaccatcagcgggacccaggctattgatgaggctgtctacttctgtcaggcgtgggacaacagcgtggtgttcggcggagggaccagtctgaccgtcttaggtcagccaggctcgccccctccggtcactc

SEQ ID NO: 599872 - DNA, 513 bp, Homo sapiens
  misc_feature: HIJSMM301D8G7P.43.81.H04.1.454.light.4.raw
tgtgagtagtcacgaccggtgctcgatttagtagtgtagattcgcggggctggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttggggcaaagctgccctgacactgtcaggtgtgcaccctgaggacgaggctgagtattactgtctgctccactttcgtactgcctgggtcttcggcgggggacgtcagttgaccgtcctaggtcagcccaaggctgccccctcggtcactctgtcgccctcctcacta

SEQ ID NO: 599873 - DNA, 495 bp, Homo sapiens; identical to SEQ ID NO: 538269
  misc_feature: HIJSMM301BP0H6.9.1.A01.1.454.light.4.raw

SEQ ID NO: 599874 - DNA, 487 bp, Homo sapiens
  misc_feature: HIJSMM301DOI2Q.17.57.F02.1.454.light.4.raw
  modified_base (435)..(435): a, c, t, g, unknown or other
cgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagcaactttttaaattggtatcagcgggaaccagggaaagcccctaaactcctgatctatactgcatccaatttgcaaagtgggtcccatcaaggttcagtggcagtggatctgggacagatttcactctcaccatcagcagtctgcaacctgaggattttgcaacttactactgtcaacagggttacagtaccccgtanacttttggccaggggaccaagctggagatcaaacgaactgtggctgcaccat

SEQ ID NO: 599875 - DNA, 513 bp, Homo sapiens
  misc_feature: HIJSMM301B4JB9.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatcttcttatcgttcttcggaaactgggaaccaaggtccaccgtcctaggtcagcccaaggcccaacccactgtcta

SEQ ID NO: 599876 - DNA, 496 bp, Homo sapiens; identical to SEQ ID NO: 537925
  misc_feature: HIJSMM301AZ9TJ.22.14.B03.1.454.light.4.raw

SEQ ID NO: 599877 - DNA, 520 bp, Homo sapiens; identical to SEQ ID NO: 563649
  misc_feature: HIJSMM301BPL3A.27.23.C01.1.454.light.4.raw

SEQ ID NO: 599878 - DNA, 513 bp, Homo sapiens; identical to SEQ ID NO: 536917
  misc_feature: HIJSMM301B5NLS.16.83.H06.1.454.light.4.raw

SEQ ID NO: 599879 - DNA, 513 bp, Homo sapiens; identical to SEQ ID NO: 552442
  misc_feature: HIJSMM301DDRGZ.47.85.H08.1.454.light.4.raw

SEQ ID NO: 599880 - DNA, 494 bp, Homo sapiens; identical to SEQ ID NO: 534992
  misc_feature: HIJSMM301BK34Y.9.1.A01.1.454.light.4.raw

SEQ ID NO: 599881 - DNA, 512 bp, Homo sapiens
  misc_feature: HIJSMM301BEC85.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggtcgttcggtccaagggaccgaaaggtaggaaagtacaaaacgaactagtggctgcaccatctgtcttctatcttccccg

SEQ ID NO: 599882 - DNA, 417 bp, Homo sapiens; identical to SEQ ID NO: 568651
  misc_feature: HIJSMM301EZQP3.19.86.H09.1.454.light.4.raw

SEQ ID NO: 599883 - DNA, 491 bp, Homo sapiens; identical to SEQ ID NO: 535294
  misc_feature: HIJSMM301B0PW2.16.68.G02.1.454.light.4.raw

SEQ ID NO: 599884 - DNA, 517 bp, Homo sapiens
  misc_feature: HIJSMM301CNGS7.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcacatctgtcttcatcttccccg

SEQ ID NO: 599885 - DNA, 491 bp, Homo sapiens
  misc_feature: HIJSMM301CTSWM.40.11.A11.1.454.light.4.raw
tctagcgactcacgaccggtgctcgatttagctacgactgcaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtcttttatacaactccaacaagcagcactacttagcttggtaccagcagaaaccaggacagcctcctaaactgctcatttactgggcctctacccgggaatccggggtccctgaccgattcagtggcagcgggtctgggacagatttcactctgaccatcagcagcctgcaggctgaagatgtggcagtttattactgtcaacaatattatattattccgaggacgttcggccaagggaccaaggtggaaatcaaacgaactgtggctgcaccatctgtcttcatctcccgccat

SEQ ID NO: 599886 - DNA, 489 bp, Homo sapiens
  misc_feature: HIJSMM301CAOK5.49.42.D09.1.454.light.4.raw
agtcgagagacacgaccggtgctcgatttagacacatacgcagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcagcgtagcaactggcctctcactttcggcgagggaccaaggtggagatcaaacgaactgtggctgcaccatctgtt

SEQ ID NO: 599887 - DNA, 496 bp, Homo sapiens; identical to SEQ ID NO: 553382
  misc_feature: HIJSMM301B3V59.51.59.F04.1.454.light.4.raw

SEQ ID NO: 599888 - DNA, 471 bp, Homo sapiens
  misc_feature: HIJSMM301A8TWM.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatccttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacttttggcggggggaccaaggtggacatcaaacgaa

SEQ ID NO: 599889 - DNA, 515 bp, Homo sapiens
  misc_feature: HIJSMM301B6BSA.40.47.E03.1.454.light.4.raw
tctagcgactcacgaccggtgctcgatttagactcgcgcacagagagaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccaataatgacgttggtggttacaactatgtctcctggtaccaacaatacccaggcaaagcccccaaactcctgatttatgaggtcagtaagcggccctcaggggtccctgatcgcttctctggctccaagtctgtcaacacggcctccctgaccgtctctgggctccaggctgaggatgaggctgtttactactgcagctcatatgcaggcagcaataatttggtgttcggcggggggaccgaagctgaccgtcctaggtcagcccaaggctgccccctccggtcactcttcg

SEQ ID NO: 599890 - DNA, 521 bp, Homo sapiens; identical to SEQ ID NO: 538715
  misc_feature: HIJSMM301BJO4S.27.23.C01.1.454.light.4.raw

SEQ ID NO: 599891 - DNA, 486 bp, Homo sapiens
  misc_feature: HIJSMM301C8AMS.3.77.G11.1.454.light.4.raw
agacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgtttctccaggggaaacagtctccctctcctgcagggccagtcagagtgtcaacaacaacttagcctggtatcaacagaaacctggccaggctcccaggctcctcatctatgatgtgtcttctcgggtcactggtctcccaggcaggttcagtggcagtggatctgggacagaattcacgctcaccatcatcaggctgcggtctgacgacttcgcagtctatttctgtcaacagtacgatggccggactccgtggacattcggccaaggtaccaaggtggacatcagacgaactgtggctgcacc

SEQ ID NO: 599892 - DNA, 504 bp, Homo sapiens
  misc_feature: HIJSMM301D8OI9.10.33.C11.1.454.light.4.raw
  modified_base (480)..(480): a, c, t, g, unknown or other
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctcctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagatttttactctcggcatccgcagcctgcagcctgaagattttgcgacatattactgtcaacagtatgaaaatgtcccgctcactttcggcgggggacggaacggtggaggtctaacgaaactagtggtntcgcaccactctgtcgttctactt

SEQ ID NO: 599893 - DNA, 486 bp, Homo sapiens; identical to SEQ ID NO: 535043
  misc_feature: HIJSMM301CNZ45.46.35.D02.1.454.light.4.raw

SEQ ID NO: 599894 - DNA, 475 bp, Homo sapiens
  misc_feature: HIJSMM301D8W8J.51.47.E03.1.454.light.4.raw
cgatcgtatacacgaccggtgctcgatttagactcgcgcacagagagaaggggctgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcacctgttctggagacagattgactgataaatatgctggctggtatcggcagaagccaggccagtcccctgtgttggtcatctatcaggataccaagcggccctcagggatccctgagcgattctctggctccaactctgggaacacagccactctgaccatcagcgggactcaggctatcgatgaggctgactattactgtcaggcgtgggacagccgcactggggtattcggcggagggaccaagctgaccgtcctgagtcagcccc

SEQ ID NO: 599895 - DNA, 519 bp, Homo sapiens
  misc_feature: HIJSMM301EV0QF.51.78.H01.1.454.light.4.raw
cgatcgtatacacgaccggtgctcgatttagtgtgagtagtttgggtttggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacagaaacacttgggtgttcggcggcgggaccaaactgaccgtcctacgtcagcccaaggctgccccctcggtcactctgttcccta

SEQ ID NO: 599896 - DNA, 500 bp, Homo sapiens
  misc_feature: HIJSMM301CPK2M.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagataccattggagaaagagtgatgacgcagtctccagccaccctgtctgtgtctccaggggaaagcgccactctctcctgcagggacagtcagactgttagcaccaacttagcctggtatcagcagaaacctggccagtctcccaggctcctcatctatggtgcatccaccagggcccctggtgtcccagccaggttcagtggcagtgggtctgggacagagttcactctcaccatcagcggcctgcagtctgaagattttgcagtttattactgtcagcagtataattactggccgccgacgttcggccaagggaccaaaggtggaaatacaaacgaactacgtggctgcaccatctgtcttcta

SEQ ID NO: 599897 - DNA, 503 bp, Homo sapiens
  misc_feature: HIJSMM301EXV9X.10.68.G02.1.454.light.4.raw
catagtagtgcacgaccggtgctcgattagtcgatagtgaagggaaaggggggtgtgggctcaggaggcagagctctgggaatctcaccatggcctggacccctctcctgctccccctcctcactttctgcacagtctctgaggcctcgtatgaactgacacagccaccctcggtgtcagtgtccccaggacagactgccaggatcagctgctctggagatgcattgccaaacaaaatatgcttattggtacgagcaaaagccaggccaggcccctgtcttgttgatatatgaggacaccaagcgaccctccggaatttctgagagattctccggctccagctcagggacagtggcctccttgactatcagtggggcccagggggtcgatgaggctgactactactgtttctcgactgacttcactggtaaacgttggctgttcggcggagggaccaagctgaccgtcctgcgtcagcccaaggctgccccctcggtcactcc

SEQ ID NO: 599898 - DNA, 483 bp, Homo sapiens; identical to SEQ ID NO: 545669
  misc_feature: HIJSMM301CVZL1.13.8.A08.1.454.light.4.raw

SEQ ID NO: 599899 - DNA, 509 bp, Homo sapiens; identical to SEQ ID NO: 543266
  misc_feature: HIJSMM301D63V5.17.33.C11.1.454.light.4.raw

SEQ ID NO: 599900 - DNA, 518 bp, Homo sapiens; identical to SEQ ID NO: 545878
  misc_feature: HIJSMM301BLO5K.41.25.C03.1.454.light.4.raw

SEQ ID NO: 599901 - DNA, 494 bp, Homo sapiens; identical to SEQ ID NO: 534992
  misc_feature: HIJSMM301AJ5JZ.9.1.A01.1.454.light.4.raw

SEQ ID NO: 599902 - DNA, 487 bp, Homo sapiens; identical to SEQ ID NO: 539157
  misc_feature: HIJSMM301DDGEW.26.37.D04.1.454.light.4.raw

SEQ ID NO: 599903 - DNA, 506 bp, Homo sapiens
  misc_feature: HIJSMM301E2J57.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccaagggaccaaggtggaaatacaaacgaactagtggcgtgcaccatctgtcttcatcttccccg

SEQ ID NO: 599904 - DNA, 493 bp, Homo sapiens; identical to SEQ ID NO: 536289
  misc_feature: HIJSMM301A2U72.14.5.A05.1.454.light.4.raw

SEQ ID NO: 599905 - DNA, 471 bp, Homo sapiens
  misc_feature: HIJSMM301AXU63.7.81.H04.1.454.light.4.raw
cgtgtctctacacgaccggtgctcgatttagtagtgtagattcgcgggggagtcaggtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcgccctgggactgaagtgcatatgaagagaactgtgg

SEQ ID NO: 599906 - DNA, 489 bp, Homo sapiens
  misc_feature: HIJSMM301EGD0D.47.36.D03.1.454.light.4.raw
agctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaagcccctaacctcctcatctctactgcatccactttgcaaagtggggtcccatcaaggttcagcggcagtggatctgggacagatttcactctcactatcagcagcctgcagcctgaagattttggaactttattattgtcaacagggtaacagtttcccgctcaccttcggcggagggaccaaggtggagatgaaaagactgtggctgcaccat

SEQ ID NO: 599907 - DNA, 502 bp, Homo sapiens; identical to SEQ ID NO: 541971
  misc_feature: HIJSMM301CBSH7.4.39.D06.1.454.light.4.raw

SEQ ID NO: 599908 - DNA, 521 bp, Homo sapiens; identical to SEQ ID NO: 539470
  misc_feature: HIJSMM301ENC2J.27.23.C01.1.454.light.4.raw

SEQ ID NO: 599909 - DNA, 496 bp, Homo sapiens; identical to SEQ ID NO: 535109
  misc_feature: HIJSMM301A00RY.16.78.H01.1.454.light.4.raw

SEQ ID NO: 599910 - DNA, 489 bp, Homo sapiens
  misc_feature: HIJSMM301A1DLH.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattattacttcgtggacgttcggccgaagggaccgaaggtggatatcagacgaa

SEQ ID NO: 599911 - DNA, 447 bp, Homo sapiens; identical to SEQ ID NO: 535020
  misc_feature: HIJSMM301DGX2Q.18.9.A09.1.454.light.4.raw

SEQ ID NO: 599912 - DNA, 492 bp, Homo sapiens
  misc_feature: HIJSMM301BWFDX.48.15.B04.1.454.light.4.raw
agtatacatacacgaccggtgctcgatttagacagtatatatccgcgggcacgaccggtgctcgatttagtctagcgactttgggtttgggggaagagctgctcagttaggacccagagggaaccatggaaaccccagcgcagcttctcttcctcctgctactctggctcccagataccaccggagcacttgtgttgacgcagtctccaggcaccctgtctttgtctccaggggagagagccaccctctcctgcagggccagtcagagtgttagcggcggctccgtagcctggtaccagcagaaacgtggccaggttcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacctcaactcactttcggcggac

SEQ ID NO: 599913 - DNA, 515 bp, Homo sapiens
  misc_feature: HIJSMM301BMR87.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctcgccccctcggtcactctgttccccg

SEQ ID NO: 599914 - DNA, 512 bp, Homo sapiens
  misc_feature: HIJSMM301B2HUE.8.42.D09.1.454.light.4.raw
ctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctcctgaccgtctctgggctccagactgaggatgaggctgattattactgcagctcatattcaggcagcaacagggtattcggcggagggaccaagttgaccgtcctaggtcagcccaaggcctgccccctcggtcactctgttcccacccttccc

SEQ ID NO: 599915 - DNA, 506 bp, Homo sapiens; identical to SEQ ID NO: 534969
  misc_feature: HIJSMM301EMEVQ.18.37.D04.1.454.light.4.raw

SEQ ID NO: 599916 - DNA, 464 bp, Homo sapiens
  misc_feature: HIJSMM301C1RSC.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccaccgaggttcagtggaagtggatctgggacagactttactctcaccatcagcagcctgcagcctgaagatattgcaacatattactgtcaacagtatgatcgtctcctcaattttcggccctgggaccagagtggacatgaaacgaa

SEQ ID NO: 599917 - DNA, 305 bp, Homo sapiens; identical to SEQ ID NO: 539887
  misc_feature: HIJSMM301C58XE.49.19.B08.1.454.light.4.raw

SEQ ID NO: 599918 - DNA, 479 bp, Homo sapiens; identical to SEQ ID NO: 537163
  misc_feature: HIJSMM301C8OZS.13.73.G07.1.454.light.4.raw

SEQ ID NO: 599919 - DNA, 506 bp, Homo sapiens
  misc_feature: HIJSMM301BJTN9.41.40.D07.1.454.light.4.raw
tctatactatcacgaccggtgctcgatttagtgatagagcgtaacaacagagggggagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagttcacctctaactttcggcggagggaccaaggtggagatcaaacgaactgtggctgcaccatctgtcttcatcttccccg

SEQ ID NO: 599920 - DNA, 493 bp, Homo sapiens
  misc_feature: HIJSMM301C6GSF.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttcctgaccatcactgggctcaggcgaagatgaggctgactattactgtaactcccgggccagcagtggtaacattgtgatattcggcggagggaccaaggtgaccgtcctacgtcagcccaaggctgccccctggtcactctcg

SEQ ID NO: 599921 - DNA, 495 bp, Homo sapiens
  misc_feature: HIJSMM301CGJRB.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaactgtgctgcaccatctgt

SEQ ID NO: 599922 - DNA, 490 bp, Homo sapiens; identical to SEQ ID NO: 544761
  misc_feature: HIJSMM301D2UK4.17.49.E05.1.454.light.4.raw

SEQ ID NO: 599923 - DNA, 534 bp, Homo sapiens
  misc_feature: HIJSMM301A6HYP.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgttagttcatatacaaccagtgacacttgggtggttcggcgggagggaaccacgggctggacccgtccttaggtcacgcccaaggctcgccccctcggtcactctcgttcccacccct

SEQ ID NO: 599924 - DNA, 513 bp, Homo sapiens
  misc_feature: HIJSMM301EJFR8.49.73.G07.1.454.light.4.raw
agtcgagagacacgaccggtgctcgatttagctctacgctcagggcacgaccggtgctcgatttagcacacgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacataaacacttgggtgttcggcggcgggaccaaactgtacccg

SEQ ID NO: 599925 - DNA, 447 bp, Homo sapiens
  misc_feature: HIJSMM301CM3GA.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactagtaccagcagcttccagggacagcccccaaactcctcatctttggtagcaacaatcggccctcaggggtccctgaccgattctctggctccaagtctggtacctcagcctccctggccatcactgggctccaggctgaggatgaggctgactattactgccagtcctatgacatgaggctgagtggttcgtatgtcttcggatctgggaccaaggtcaccgtcctaagtcagcccaaagccaacccctctgtcactctgttcccaccctcctccatactcgta

SEQ ID NO: 599926 - DNA, 493 bp, Homo sapiens
  misc_feature: HIJSMM301DG4AQ.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaaggtggaggtcaaacgaaactgtggctgcaccatctgtcttcatt

SEQ ID NO: 599927 - DNA, 503 bp, Homo sapiens; identical to SEQ ID NO: 536834
  misc_feature: HIJSMM301ATA0V.2.35.D02.1.454.light.4.raw

SEQ ID NO: 599928 - DNA, 496 bp, Homo sapiens; identical to SEQ ID NO: 537925
  misc_feature: HIJSMM301DIECC.22.14.B03.1.454.light.4.raw

SEQ ID NO: 599929 - DNA, 488 bp, Homo sapiens; identical to SEQ ID NO: 535990
  misc_feature: HIJSMM301A3QU1.11.28.C06.1.454.light.4.raw

SEQ ID NO: 599930 - DNA, 475 bp, Homo sapiens
  misc_feature: HIJSMM301EI9X6.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacgttttggcggggggtaccgaaggtggacatcaaacgaa

SEQ ID NO: 599931 - DNA, 486 bp, Homo sapiens; identical to SEQ ID NO: 535917
  misc_feature: HIJSMM301ETR8R.3.10.A10.1.454.light.4.raw

SEQ ID NO: 599932 - DNA, 492 bp, Homo sapiens
  misc_feature: HIJSMM301A4H2V.52.82.H05.1.454.light.4.raw
cgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggacactgagaggccctcagggatccctgagcgattctctggctccacctcagggacactagtcacgttgaccatcagtggagtccaggcaggaggacgaggctgactaccactgtcaatcaacagacagcagtggttcttatgtcttcgcaactgggaccaaggtcaccgtcctaggtcagcccaaggccaacccactgtcact

SEQ ID NO: 599933 - DNA, 508 bp, Homo sapiens
  misc_feature: HIJSMM301BIYDO.43.3.A03.1.454.light.4.raw
tgtgagtagtcacgaccggtgctcgatttagagagcgtcacagggggcgtgggtggtagctcaggaagcagagcctggagcatctccactatgggcctgggctccactacttctcaccctcctcgctcactgcacagggttcttgggccagttttatgctgactcagccccactctgtgtcggagtctccggggaagacggtaaccatctcctgcacccgcagcggtggctttattgccagcaataatatgcagtggtaccagcagcgcccgggcagtcccccacactgtgatctatgaggatgaccaaagaccctctggggtccctaatcggttctctggctccgtcgacacctcctccaactctgcctacctcaccatctctggactgaagactgaggacgaggctgactattactgtcactcttatgatcgcaacaacagggtgttcggcggagggaccagggttgaccgtccttggtcagcccaaggctgccccctcggtcact

SEQ ID NO: 599934 - DNA, 521 bp, Homo sapiens; identical to SEQ ID NO: 538715
  misc_feature: HIJSMM301AUXD2.27.23.C01.1.454.light.4.raw

SEQ ID NO: 599935 - DNA, 510 bp, Homo sapiens
  misc_feature: HIJSMM301EQDHC.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggccggggaccgaccgtggaagtacaaacgaactagtggctgcaccatctgtctt

SEQ ID NO: 599936 - DNA, 494 bp, Homo sapiens; identical to SEQ ID NO: 535276
  misc_feature: HIJSMM301AJ906.16.6.A06.1.454.light.4.raw

SEQ ID NO: 599937 - DNA, 505 bp, Homo sapiens; identical to SEQ ID NO: 546412
  misc_feature: HIJSMM301DZ5KF.22.21.B10.1.454.light.4.raw

SEQ ID NO: 599938 - DNA, 499 bp, Homo sapiens
  misc_feature: HIJSMM301AZQ3Q.12.86.H09.1.454.light.4.raw
atacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgaagattttgcagtttattactgtcagcagcgtagcaactggcctcggttcacttttggtcaggggaccaagctggagatcaaacgaactgtggctgcaccatctgtcttcatt

SEQ ID NO: 599939 - DNA, 491 bp, Homo sapiens
  misc_feature: HIJSMM301D0NR5.40.81.H04.1.454.light.4.raw
tctagcgactcacgaccggtgctcgatttagtagtgtagattcgcgggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagattttacactgaaaatcagcagggtggaggcagaagatgttgggatttattactgcatgcaacctctacaaactgtgtggacggtcggccaagggaccaaggtggaaatcaagcgaactgtggctgcac

SEQ ID NO: 599940 - DNA, 507 bp, Homo sapiens; identical to SEQ ID NO: 538063
  misc_feature: HIJSMM301BAALZ.47.85.H08.1.454.light.4.raw

SEQ ID NO: 599941 - DNA, 463 bp, Homo sapiens
  misc_feature: HIJSMM301A82U2.52.8.A08.1.454.light.4.raw
cgcagtacgacacgaccggtgctcgatttagcatactctacagggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcgggggaccgaaggtcggagatcaagcgaa

SEQ ID NO: 599942 - DNA, 509 bp, Homo sapiens
  misc_feature: HIJSMM301D7K70.3.53.E09.1.454.light.4.raw
agacgcactccacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaaaaagaactacttaggttggtaccagcagaaaccagggcagcctcctaagctgctcattacctgggcatctacccgggaatctggggtccctgaccgattcagtggcagcgggtctgggacagatttcactctcaccatcaccaacccgcaggctgaagatgtggccgtttattactgtcagcaatattatggtactcctccgtggacgttcggccaagggaccaaggtggaaatcaaacgaactgtggctgcaccatctgtt

SEQ ID NO: 599943 - DNA, 512 bp, Homo sapiens; identical to SEQ ID NO: 552150
  misc_feature: HIJSMM301EQ1LT.17.33.C11.1.454.light.4.raw

SEQ ID NO: 599944 - DNA, 473 bp, Homo sapiens
  misc_feature: HIJSMM301BWI3M.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatcctccctgtctgcatctgtaggagacagagtcaccatcacttgccgggcaagtcagggcattagaaatgatttaggctggtatcagcagaaaccagggaaagccctaagctcttgatctatggtgcatccagtttaaaagtgggtccatcaaggttcagcggcagtggatctggcacagacttcattctcaccatcagcagcctgcagcctgaagtatttgcaacttattactgtctacaagatcacaattatctggacgtcggccaaggaccaaggtaggaatacaacgaactagtgctgcac

SEQ ID NO: 599945 - DNA, 498 bp, Homo sapiens
  misc_feature: HIJSMM301CZPXO.40.11.A11.1.454.light.4.raw
tctagcgactcacgaccggtgctcgatttagctacgactgcaggggcgagcaagatggtgttgcagacccaggtcttctatttttcttgttgctctggatctctggtgcctacggggacatcgtgatgacccagtctccagactccctggctgtgtctctgggcgagagggccaccatcaactgcaagtccagccagagtcttttatacaactccaacaagcagcactacttagcttggtaccagcagaaaccaggacagcctcctaaactgctcatttactgggcctctacccgggaatccggggtccctgaccgattcagtggcagcgggtctgggacagatttcactctgaccatcagcagcctgcaggctgaagatgtggcagtttattactgtcaacaatattatattattccgaggacgttcggccaagggacccaaggtggaaatacaaacgaactgtggctgcaccatctgtcttcatcttccccgccat

SEQ ID NO: 599946 - DNA, 478 bp, Homo sapiens; identical to SEQ ID NO: 535129
  misc_feature: HIJSMM301EBV18.11.11.A11.1.454.light.4.raw

SEQ ID NO: 599947 - DNA, 488 bp, Homo sapiens; identical to SEQ ID NO: 535081
  misc_feature: HIJSMM301C9ZTX.26.23.C01.1.454.light.4.raw

SEQ ID NO: 599948 - DNA, 472 bp, Homo sapiens; identical to SEQ ID NO: 536302
  misc_feature: HIJSMM301BODIH.18.76.G10.1.454.light.4.raw

SEQ ID NO: 599949 - DNA, 475 bp, Homo sapiens; identical to SEQ ID NO: 537714
  misc_feature: HIJSMM301DVH6E.7.81.H04.1.454.light.4.raw

SEQ ID NO: 599950 - DNA, 505 bp, Homo sapiens; identical to SEQ ID NO: 555214
  misc_feature: HIJSMM301EQ3T4.19.78.H01.1.454.light.4.raw

SEQ ID NO: 599951 - DNA, 499 bp, Homo sapiens; identical to SEQ ID NO: 537739
  misc_feature: HIJSMM301BZDDE.12.86.H09.1.454.light.4.raw

SEQ ID NO: 599952 - DNA, 494 bp, Homo sapiens; identical to SEQ ID NO: 534994
  misc_feature: HIJSMM301BSE91.27.78.H01.1.454.light.4.raw

SEQ ID NO: 599953 - DNA, 495 bp, Homo sapiens; identical to SEQ ID NO: 563808
  misc_feature: HIJSMM301A4MT1.40.57.F02.1.454.light.4.raw

SEQ ID NO: 599954 - DNA, 496 bp, Homo sapiens; identical to SEQ ID NO: 541772
  misc_feature: HIJSMM301AS3QD.51.81.H04.1.454.light.4.raw

SEQ ID NO: 599955 - DNA, 486 bp, Homo sapiens
  misc_feature: HIJSMM301BVECQ.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggtcaggggaccaagctggagatcaaacgaactgtggctgcaccat

SEQ ID NO: 599956 - DNA, 491 bp, Homo sapiens; identical to SEQ ID NO: 543372
  misc_feature: HIJSMM301BGEZM.47.55.E11.1.454.light.4.raw

SEQ ID NO: 599957 - DNA, 486 bp, Homo sapiens
  misc_feature: HIJSMM301APWYG.17.39.D06.1.454.light.4.raw
cgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaaacctggccaggctcccaggctcctcatgtatggtgcatctaccagggccactggtgtcccagccaggttcagtggcagtgggtctgggacagagttctctctcatcatcagcagcctgcagtctgaagattttgcggtttattactgtcagcagtataatcaggtggcctccgtggacgttcggccaaggaccgaaggtggaaatacaaacgaactgtgg

SEQ ID NO: 599958 - DNA, 502 bp, Homo sapiens; identical to SEQ ID NO: 536253
  misc_feature: HIJSMM301BWCFL.21.22.B11.1.454.light.4.raw

SEQ ID NO: 599959 - DNA, 477 bp, Homo sapiens
  misc_feature: HIJSMM301ENZIR.13.76.G10.1.454.light.4.raw
tcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatggaggctgactattactgtcaggcgtgggacagcagcactgcccgctatgtctcggaactgggaccaaggtcaccgtctaagtcagaccccg

SEQ ID NO: 599960 - DNA, 516 bp, Homo sapiens; identical to SEQ ID NO: 545398
  misc_feature: HIJSMM301AN89T.48.17.B06.1.454.light.4.raw

SEQ ID NO: 599961 - DNA, 468 bp, Homo sapiens
  misc_feature: HIJSMM301D83EY.51.34.D01.1.454.light.4.raw
cgatcgtatacacgaccggtgctcgatttagatcgtctgtgttgggtttgggggcagaagtctctctcagtcaggacacagcatggacatgagggtccctgctcagctcctgggactcctgctgctctggctcccagataccagatgtgacatccagatgacccagtctccatcctccctgtctgcatctataggagacagagtcaccatcacttgccgggcgagtcagggcgtcagcatttatttggcctggtatcagcagagaccagggaaagctcctaaactcctgatctatgaggcatccactttacaatcaggggtcccatctcgtttcagtggcagtggatctggggcacatttcactctcaccatcagcagcctgcagcctgacgatgttgcaacttattactgtcaaaattataacaggccgttgcgctcactttcggcgggggaccgaaggtggagatc

SEQ ID NO: 599962 - DNA, 512 bp, Homo sapiens; identical to SEQ ID NO: 552719
  misc_feature: HIJSMM301EKXVZ.22.36.D03.1.454.light.4.raw

SEQ ID NO: 599963 - DNA, 519 bp, Homo sapiens
  misc_feature: HIJSMM301CYCY8.41.55.E11.1.454.light.4.raw
tctatactatcacgaccggtgctcgatttagcactcgcacgttgggtttgggggggcctaaggaagcagcactggtggtgcctcagccatggcctggaccgttctcctcctcggcctcctctctcactgcacagcctctgtgacctcctatgtgttgactcagccaccctcggcgtcagtggccctaggacagacggccaggattacctgtggggcaaataagataggaactacaaatgtgcactggtaccaacagaggccaggccaggcccctgtggtggtcgtccatgatgattacgaccggccctcaggaatccctgagcgattctctggctccaattctgggaacacggccaccctgaccatcaccggggtcgaggccggggatgaggccacctactattgtcacgtctgggagactggtgatgatcctgtggcgctattcggcggagggacgaagctgaccgtcctgggtcagcccaaggctgccccctcggtcactctgttcccgccctcctc

SEQ ID NO: 599964 - DNA, 488 bp, Homo sapiens
  misc_feature: HIJSMM301ASK6S.51.45.E01.1.454.light.4.raw
cgatcgtatacacgaccggtgctcgatttagtgagtcagtaagggaaaggggactgatcaggactcctcagttcaccttctcacaatgaggctccctgctcagctcctggggctgctaatgctctgggtctctggatccagtggggatattgtcatgactcagtctccactctccctgcccgtcacccctggagagccggcctccatctcctgcaggtctagtcagagcctcctccataatagtggattcttctatttggattggtacgtgctgaagccagggcagtctccacaactcctgatctatttgcgttctaatcgggcctccggggtccctgacaggttcagtggcagtggatcaggcacagattttacactgacaatcaacagagtggaggctgaggatgttggggtttattactgcgtgcaaagtctgcaaactatcaccttcggccaagggacacgactggagattaaacgaactgtgg

SEQ ID NO: 599965 - DNA, 512 bp, Homo sapiens
  misc_feature: HIJSMM301EFODX.41.41.D08.1.454.light.4.raw
tctatactatcacgaccggtgctcgatttagtcacgcgagaaagggaaagggggcttcagctgtgggtagagaagacaggactcaggacaatctccagcatggccagcttccctctcctcctcaccctcctcactcactgtgcagggtcctgggcccagtctgtgctgactcagtcaccctctgcgtctgggacccccgggcagagggtcaccatgtattgtgctgggagcaggtccaacatcggacgtaatactgtgagttggtatcagcaagtcccaggaacggcccccaaactcctcgtttctggaaacaatcagcggccctcaggagtccctgagcgattctctggctccaagtctggcacctcagcctccctggccatcagagggctccagtccgaggatgagggtgtttattattgtgcagtctgggatgacagtctgaatggtcattgggtgttcggcggagggaccaagttgaccgtcctaggtcagccccaggctgccccctc

SEQ ID NO: 599966 - DNA, 485 bp, Homo sapiens; identical to SEQ ID NO: 535985
  misc_feature: HIJSMM301CDPK5.15.1.A01.1.454.light.4.raw

SEQ ID NO: 599967 - DNA, 494 bp, Homo sapiens; identical to SEQ ID NO: 534994
  misc_feature: HIJSMM301CYEES.27.78.H01.1.454.light.4.raw

SEQ ID NO: 599968 - DNA, 502 bp, Homo sapiens
  misc_feature: HIJSMM301C21U7.9.12.B01.1.454.light.4.raw
  modified_base (429)..(429): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttcncgggcttcggccaagggaccaaggtggaaatcaaacgaactagtggctgcaccatctgtcttcatcttccccg

SEQ ID NO: 599969 - DNA, 504 bp, Homo sapiens
  misc_feature: HIJSMM301BR10G.15.66.F11.1.454.light.4.raw
tctacgtagccacgaccggtgctcgatttagtcacgcgagaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcaggggtccctgatcgcttctctggctccaagtctggcgactcggcctccctgaccgtctctgggctccagcctgaagatgaggctgattatttctgcggctcatatggagacaattacagctttgtcttcggaagtgggaccaaggtcaccgtcctaagtcagcccaaggccaaccccactgtcactctgttcccgccct

SEQ ID NO: 599970 - DNA, 478 bp, Homo sapiens; identical to SEQ ID NO: 545407
  misc_feature: HIJSMM301DF6CH.5.70.G04.1.454.light.4.raw

SEQ ID NO: 599971 - DNA, 500 bp, Homo sapiens
  misc_feature: HIJSMM301AL40T.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggaaagagccaccctctcctgcagggccagtcagagtgttagtagcaacttagcctggtaccagcatattcttggccaggctcccaggctcctcatctatggtgcatccacccgggccactggtatcccagccaggttcagtggcagtgggtctcggacagagttcactctcaccatcagcagcctggagtctgaagactctgcagtttattactgtcagcagtataattactggccgtggacgttcggccaagggaccaaggtggaaatcaaacgaactgtggctgcaccatctgtcttcatcttcccg

SEQ ID NO: 599972 - DNA, 490 bp, Homo sapiens; identical to SEQ ID NO: 542643
  misc_feature: HIJSMM301CNLHX.22.65.F10.1.454.light.4.raw

SEQ ID NO: 599973 - DNA, 501 bp, Homo sapiens
  misc_feature: HIJSMM301BUITA.41.18.B07.1.454.light.4.raw
tctatactatcacgaccggtgctcgatttagtcgctgcgtaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcggggggaccaagctgaccgtcctaggtcagcccaaggctgccccctcggtcactctgttcccc

SEQ ID NO: 599974 - DNA, 508 bp, Homo sapiens
  misc_feature: HIJSMM301BCFZJ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaactagttttctcgggcgttcggccaagggaccgaaggtaggaaatacaaacgaacctagtggctgcaccatctgtcttcatcttccccg

SEQ ID NO: 599975 - DNA, 521 bp, Homo sapiens; identical to SEQ ID NO: 573861
  misc_feature: HIJSMM301ESF9X.27.23.C01.1.454.light.4.raw

SEQ ID NO: 599976 - DNA, 492 bp, Homo sapiens; identical to SEQ ID NO: 570842
  misc_feature: HIJSMM301A8D9P.22.65.F10.1.454.light.4.raw

SEQ ID NO: 599977 - DNA, 522 bp, Homo sapiens
  misc_feature: HIJSMM301BCCZ1.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttatacggctccgacaacaagaactacttagcttggtatcagcagaaaccaggacagcctcctaaactgctcattaactgggcatctacccggcaatccggggtccctgaccgattcagtggcagcgggtcgtgggacagatttcactctcaccatcagcagcctgcaggctgaagatgtggcagtttattactgtcaactagttttctcgggcgttcggccgaacgggaccgaacgggtaggaaagtacaaaacgaacctagtggcgtgcaccactctcgtcttctatctttcccccg

SEQ ID NO: 599978 - DNA, 516 bp, Homo sapiens
  misc_feature: HIJSMM301D2BZD.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttcctcccccggacgttcgtcgacggaccgaacggtaggaaagtacaacgacgaactacgtggcgtgcgaccactctgtcttctactcttcccgt

SEQ ID NO: 599979 - DNA, 511 bp, Homo sapiens
  misc_feature: HIJSMM301DTDOF.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatccggccccccgactcctcatctatagaaatgatcatcggccctccggggtccctgaccgattctctggctccatgtctggcacctcagccctccctgaccatcagtgggctccggtccgaggatgaggctgattattactgtgcaccgtgggatgacatcctgaatggtccggtgttcggcggagggaccaggctgaccgtcctaagtcagcccaaggctgccccctc

SEQ ID NO: 599980 - DNA, 496 bp, Homo sapiens; identical to SEQ ID NO: 550221
  misc_feature: HIJSMM301A1MJH.10.79.H02.1.454.light.4.raw

SEQ ID NO: 599981 - DNA, 486 bp, Homo sapiens; identical to SEQ ID NO: 535043
  misc_feature: HIJSMM301EFZNC.46.35.D02.1.454.light.4.raw

SEQ ID NO: 599982 - DNA, 419 bp, Homo sapiens; identical to SEQ ID NO: 562300
  misc_feature: HIJSMM301C0AOI.41.53.E09.1.454.light.4.raw

SEQ ID NO: 599983 - DNA, 485 bp, Homo sapiens; identical to SEQ ID NO: 553363
  misc_feature: HIJSMM301EO97L.15.1.A01.1.454.light.4.raw

SEQ ID NO: 599984 - DNA, 497 bp, Homo sapiens
  misc_feature: HIJSMM301EIMWT.49.22.B11.1.454.light.4.raw
agtcgagagacacgaccggtgctcgatttagacgacagctcaggggggaactgctcagttaggacccagagggaaccatggaagccccagctcagcttctcttcctcctgctactctggctcccagatatttccgaagaaattgtgttgacacagtctccagccaccctctatctgtctccaggggaaagagccaccctctcctgcagggccagtcagagtgttaacaacttcttaggctggtatcaaacaaaaacctggccaggttcccaggctcctcgtctatgatgcgtccatcagggccactggcatcccagccaggttcagtggcagtgggtctgggacagacttcactctcaccatcagcagcctagagcctgaagactttgcagtttattactgtcagcagcgtagcaatttgatcaccttcggccaagggacacgactaggaaattaaacgaactgtggctgcaccatctgtcttcatcttcccgccat

SEQ ID NO: 599985 - DNA, 445 bp, Homo sapiens; identical to SEQ ID NO: 557838
  misc_feature: HIJSMM301EK7F3.2.76.G10.1.454.light.4.raw

SEQ ID NO: 599986 - DNA, 493 bp, Homo sapiens; identical to SEQ ID NO: 544335
  misc_feature: HIJSMM301CBNPX.5.57.F02.1.454.light.4.raw

SEQ ID NO: 599987 - DNA, 441 bp, Homo sapiens; identical to SEQ ID NO: 546257
  misc_feature: HIJSMM301D7ZEO.41.9.A09.1.454.light.4.raw

SEQ ID NO: 599988 - DNA, 502 bp, Homo sapiens; identical to SEQ ID NO: 580440
  misc_feature: HIJSMM301AT63C.2.35.D02.1.454.light.4.raw

SEQ ID NO: 599989 - DNA, 493 bp, Homo sapiens
  misc_feature: HIJSMM301DHXE6.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacatttgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccgagggtggagatcagacgaactgtggctgcaccatctgtt

SEQ ID NO: 599990 - DNA, 514 bp, Homo sapiens; identical to SEQ ID NO: 545978
  misc_feature: HIJSMM301AT4ZJ.17.33.C11.1.454.light.4.raw

SEQ ID NO: 599991 - DNA, 506 bp, Homo sapiens
  misc_feature: HIJSMM301CL1SB.2.76.G10.1.454.light.4.raw
acgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaaccgacccccaaactcctcatctctcacaataatcagcggccctcaggagtccctgaccgattctctgcctccaagtcccggcacctcagccctccctggccatcagtgggctccgggccgaggatgaggctgattattactgtgcaggatgggatgacaacctgggtgcttatctcttcggacctgggaccaaggtcaccgtccttggt

SEQ ID NO: 599992 - DNA, 497 bp, Homo sapiens; identical to SEQ ID NO: 539058
  misc_feature: HIJSMM301AUPOD.12.87.H10.1.454.light.4.raw

SEQ ID NO: 599993 - DNA, 521 bp, Homo sapiens; identical to SEQ ID NO: 539470
  misc_feature: HIJSMM301AWAHA.27.23.C01.1.454.light.4.raw

SEQ ID NO: 599994 - DNA, 503 bp, Homo sapiens
  misc_feature: HIJSMM301CYHJ3.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactgggctcaggcggaagatgaggctgactattactgtaactcccgggacagcagtgctgaccaggtggtattcggcggaggggaccccacctgaccgtcttaggtcagcccaaggctgccccctcggtcta

SEQ ID NO: 599995 - DNA, 504 bp, Homo sapiens
  misc_feature: HIJSMM301AOMHU.15.5.A05.1.454.light.4.raw
tctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctcctcgttggggcaaagctgcctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccaccctcctcgctacgtaga

SEQ ID NO: 599996 - DNA, 476 bp, Homo sapiens
  misc_feature: HIJSMM301ANJZA.52.1.A01.1.454.light.4.raw
cgcagtacgacacgaccggtgctcgatttagacgtctcatcaggggcagtctcagtcaggacacagcatggacatgagggtccccgctcagctcctggggctcctgctactctggctcctaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggttcagtggcagtggatctgggacagaattcactctcaccatcaccagtctgcaggctgaggattttgcaacttacttctgtcaacagagttacagttccctcactttcggcctgggaccatagtggatatcaaacgaactgtggctgcaccatctgtctt

SEQ ID NO: 599997 - DNA, 493 bp, Homo sapiens; identical to SEQ ID NO: 537422
  misc_feature: HIJSMM301CKHK7.9.34.D01.1.454.light.4.raw

SEQ ID NO: 599998 - DNA, 494 bp, Homo sapiens
  misc_feature: HIJSMM301B8PW2.51.71.G05.1.454.light.4.raw
cgatcgtatacacgaccggtgctcgatttagtgtcgtcgcaagagagagggggggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactcgtcact

SEQ ID NO: 599999 - DNA, 514 bp, Homo sapiens
  misc_feature: HIJSMM301B7T6V.17.33.C11.1.454.light.4.raw
  modified_base (507)..(507): a, c, t, g, unknown or other
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagcctgaccgtcttaagtcagcccaaggctgccccctcggtcactctgttcccnccctcct

SEQ ID NO: 600000 - DNA, 506 bp, Homo sapiens; identical to SEQ ID NO: 554189
  misc_feature: HIJSMM301ETAL4.19.78.H01.1.454.light.4.raw

SEQ ID NO: 600001 - DNA, 493 bp, Homo sapiens; identical to SEQ ID NO: 537422
  misc_feature: HIJSMM301D954V.9.34.D01.1.454.light.4.raw

SEQ ID NO: 600002 - DNA, 498 bp, Homo sapiens
  misc_feature: HIJSMM301EPAIE.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgccgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaactgtggctgcaccatctgtcttcatcttccccg

SEQ ID NO: 600003 - DNA, 489 bp, Homo sapiens
  misc_feature: HIJSMM301DTJ9X.52.82.H05.1.454.light.4.raw
cgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggacactgagaggccctcagggatccctgagcgattctctggctccacctcagggacacctagtcacgttgaccatcagtggagtccaggcagaggacgaggctgactaccactgtcaatcaacagacagcagtggttcttatgtcttcgcaactggacaaggtcaccgtcctagtcagcccaaggccaacccactgtcact

SEQ ID NO: 600004 - DNA, 487 bp, Homo sapiens
  misc_feature: HIJSMM301CXU4S.41.78.H01.1.454.light.4.raw
tctatactatcacgaccggtgctcgatttagtgtgagtagtttgggtttggggtgatcaggacttctcagttcatcttctcaccatgaggctccctgctcagctcctggggctgctaatgctctggatacctggatccagtgcagatattgtgatgtcccagactccactctctctgtccgtcacccctggacagccggcctccatctcctgcaagtctagtcagagtctcctccatgagaatggcaaaacttatttctactggtacctacagaaggcaggccagccgccacagctcctgatcgtatgaggttttcaggtcggttctctggagtgccagacaggttcagtggcagcgggtccgggacagatttcacactgaggatcagtcgggtggaggctgacgacgttgggacttattactgcgcgcaaagtctacacctttcctctcactttgggccctgggaccaaagtggacatcaaacgaa

SEQ ID NO: 600005 - DNA, 498 bp, Homo sapiens
  misc_feature: HIJSMM301ANQLM.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgactgtggctgcaccatctgtcttcatcttcccgccatctgacta

SEQ ID NO: 600006 - DNA, 491 bp, Homo sapiens
  misc_feature: HIJSMM301CUXIS.51.9.A09.1.454.light.4.raw
cgatcgtatacacgaccggtgctcgatttagcgagacgcgcaggggactgcgggggtaagaggttgtgtccaccatggcctggactcctctcctcctcctgttcctctctcactgcacaggttccctctcgcaggctgtgctgactcagccgtcttccctgtctgcatctcctggagcatcagccagtctcacctgcaccttgcgcagtggcttcgatgttagtacctacaggatatactggttccagcagaaggcagggagtcctccccagtttctcctaaattacaaatctgactcacgtaagcagcagggctctggagtccccagccgcttctctggatccaaagatgcttcggccaatgcggggattttactcatctctgggctccagtctgaggatgaggctgactattactgtttgatttggcacagcagcgcttgggtattcggcggggggaccaacgtgaccgtcctaggtcagcccaaggct

SEQ ID NO: 600007 - DNA, 519 bp, Homo sapiens
  misc_feature: HIJSMM301BGVQ2.49.80.H03.1.454.light.4.raw
agtcgagagacacgaccggtgctcgatttagctgtgcgtcgaagggaaagggggagtctgggcctaaggaagcagcactggtggtgcctcagccatggcctggaccgttctcctcctcggcctcctctctcactgcacaggctctgtgacctcctatgtgctgactcagacaccctcggtgtcggtggccccaggacagacggccttgattccctgtatgggagacgacattggaagtaagagtgtccactggtaccagcagaagccaggccaggcccctcttttggtcgtctatgatgatcgcgaccggcccgcaggggtccctgaacgattctctggcgccagctctcagaacacggccaccctgatcatcaacagggtcgaagtcggggatgaggccgactattactgtcaggtctgggatactgaaattgaatatgtcttcggaactgggaccaaagtcaccgtcctaggtcagcccaaggccaaccccactcgtcactctgttcccaccctcct

SEQ ID NO: 600008 - DNA, 496 bp, Homo sapiens
  misc_feature: HIJSMM301AGTST.22.14.B03.1.454.light.4.raw
  modified_base (430)..(430): a, c, t, g, unknown or other
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatnttatattcctcctcagacgttcggccaagggaccaaggtggaaatcaaacgaactgtggctgcacc

SEQ ID NO: 600009 - DNA, 496 bp, Homo sapiens
  misc_feature: HIJSMM301EYX7M.10.28.C06.1.454.light.4.raw
  modified_base (462)..(462): a, c, t, g, unknown or other
catagtagtgcacgaccggtgctcgatttagagctcacgtattgggtttgggggctttgcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctcaggggtttctgatcgcttctttgcctccaagtctggcaacacggcctccctgaccatctctgggctccagactgaggacaggctgattattactgcagctcacatacaagcggcagcggttgggtgttcggcgggggaccgacactgaccgtcctaggtcagcccaaggctgccccncggtcactctgttcccacctcctccactactatg

SEQ ID NO: 600010 - DNA, 507 bp, Homo sapiens; identical to SEQ ID NO: 588234
  misc_feature: HIJSMM301ALZZL.19.78.H01.1.454.light.4.raw

SEQ ID NO: 600011 - DNA, 513 bp, Homo sapiens
  misc_feature: HIJSMM301D2USW.15.76.G10.1.454.light.4.raw
tctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccgcctcctcgctacg

SEQ ID NO: 600012 - DNA, 495 bp, Homo sapiens
  misc_feature: HIJSMM301D4FWI.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcattggaaccatcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgtttcggcggagggaccaagctgaccgtcctaggtcagcccaaggctgccccctcggtcactctgttcccaccctcctcgagtgcgtct

SEQ ID NO: 600013 - DNA, 486 bp, Homo sapiens
  misc_feature: HIJSMM301BBK0B.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagatttgcaacttactactgtcaacagagttacggtaccccgtacacttttggccagggaccaaactggacatcaaacgaactgtggctgcaccatctgtt

SEQ ID NO: 600014 - DNA, 492 bp, Homo sapiens
  misc_feature: HIJSMM301AEQ7Q.48.38.D05.1.454.light.4.raw
agtatacatacacgaccggtgctcgatttagtatctgatagttgggttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgtccccccg

SEQ ID NO: 600015 - DNA, 504 bp, Homo sapiens
  misc_feature: HIJSMM301ECDHR.47.83.H06.1.454.light.4.raw
agctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggtttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctggggtccctgatcgcttctctggttccatccttgggaacaaagctgccctcaccatcgcgggggcccaggcagatgatgagtgtgattattactgtgtgctctatatgggcagtggcgtttgggtgttcggcggagggaccaagctgaccgtt

SEQ ID NO: 600016 - DNA, 490 bp, Homo sapiens
  misc_feature: HIJSMM301BHBR0.16.72.G06.1.454.light.4.raw
tgtactactccacgaccggtgctcgatttagctacgactgcaagggaaagggggaggaactgctcagttaggacccagacggaaccatggaagccccagcgcagcttctcttcctcctgctactctggctcccagatacctctggagaaacagtgatgacgcagtctccagccaccctctctgtgtctccaggggaaagagtcaccctctcctgcagggccagtcagagtgttagcagcaacttagcctggtatcagcagaaacctggccaggctcccaggctcctcatctatgatgcatccaccagggccactggtatcccagccaggttcagtggcagtgggtttgggacagagttcactctcaccatcagcagcctgcagtctgaagattttgcagtttattactgtcagcagtataataactggcctccggtcactttcggcggagggaccaaggtggagatcaaacgaacgtgtggctgcaccat

SEQ ID NO: 600017 - DNA, 497 bp, Homo sapiens; identical to SEQ ID NO: 537288
  misc_feature: HIJSMM301BVTCK.15.25.C03.1.454.light.4.raw

SEQ ID NO: 600018 - DNA, 502 bp, Homo sapiens
  misc_feature: HIJSMM301EHC2L.22.86.H09.1.454.light.4.raw
acatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtctctcatcgcttctcaggctccaagtctggcaacacggcctccctaaccatctctgggctccagtttgaggacgagtctacttattactgcagttcctttaaattaggcgccactctcgtggttttcggcggtaggcaccgaagtgaccgtcctcggtcagcccaaggctgccccctcggtcactctgttcccgcctcctcacgcgtatgt

SEQ ID NO: 600019 - DNA, 477 bp, Homo sapiens; identical to SEQ ID NO: 535122
  misc_feature: HIJSMM301AO8GR.26.72.G06.1.454.light.4.raw

SEQ ID NO: 600020 - DNA, 516 bp, Homo sapiens; identical to SEQ ID NO: 559065
  misc_feature: HIJSMM301DO8W5.22.28.C06.1.454.light.4.raw

SEQ ID NO: 600021 - DNA, 495 bp, Homo sapiens; identical to SEQ ID NO: 537716
  misc_feature: HIJSMM301ENB2M.22.14.B03.1.454.light.4.raw

SEQ ID NO: 600022 - DNA, 489 bp, Homo sapiens; identical to SEQ ID NO: 559210
  misc_feature: HIJSMM301CX3K2.14.55.E11.1.454.light.4.raw

SEQ ID NO: 600023 - DNA, 484 bp, Homo sapiens; identical to SEQ ID NO: 535400
  misc_feature: HIJSMM301C7XF6.46.26.C04.1.454.light.4.raw

SEQ ID NO: 600024 - DNA, 521 bp, Homo sapiens; identical to SEQ ID NO: 539470
  misc_feature: HIJSMM301ETW0R.27.23.C01.1.454.light.4.raw

SEQ ID NO: 600025 - DNA, 520 bp, Homo sapiens; identical to SEQ ID NO: 559743
  misc_feature: HIJSMM301A7H4M.27.23.C01.1.454.light.4.raw

SEQ ID NO: 600026 - DNA, 484 bp, Homo sapiens; identical to SEQ ID NO: 535400
  misc_feature: HIJSMM301CC8QP.46.26.C04.1.454.light.4.raw

SEQ ID NO: 600027 - DNA, 503 bp, Homo sapiens
  misc_feature: HIJSMM301ETKK7.41.53.E09.1.454.light.4.raw
tctatactatcacgaccggtgctcgatttagagagagtgtgttgggtttggggggggtctcaggaggcagcgctctcgggacgtctccaccatggcctgggctccgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagcccaaggctgcccccc

SEQ ID NO: 600028 - DNA, 508 bp, Homo sapiens; identical to SEQ ID NO: 536062
  misc_feature: HIJSMM301EFAI3.11.57.F02.1.454.light.4.raw

SEQ ID NO: 600029 - DNA, 489 bp, Homo sapiens; identical to SEQ ID NO: 535139
  misc_feature: HIJSMM301EFM8E.14.55.E11.1.454.light.4.raw

SEQ ID NO: 600030 - DNA, 498 bp, Homo sapiens; identical to SEQ ID NO: 535974
  misc_feature: HIJSMM301A77ED.22.27.C05.1.454.light.4.raw

SEQ ID NO: 600031 - DNA, 505 bp, Homo sapiens
  misc_feature: HIJSMM301C9Z9G.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagcccaaggctgccccctccgtcta

SEQ ID NO: 600032 - DNA, 502 bp, Homo sapiens
  misc_feature: HIJSMM301ENYK1.15.56.F01.1.454.light.4.raw
tctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaactcatgatttatgaggacaatgagcggccctcaggggtttctaatcgcttctctggctccaagtctgacaacacggcctccctgacaatctctgggctccaggctgaggacgagggtgattattacttgctgcgcatatagaagtcccactgttgtacttttcggcggagggaccaagctgaccgtcctaggtcagcccaaggctgccccctcggtcactctgttcccaccctcctcgctacgtaga

SEQ ID NO: 600033 - DNA, 508 bp, Homo sapiens
  misc_feature: HIJSMM301CZ8M5.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttccaccctcaccatcaaatagcctggaagctgaagatgctgcaacttattactgtcatcagagtaactactttacctcaagtgatcacctttcggccaagggacacggactggagattaaacg

SEQ ID NO: 600034 - DNA, 497 bp, Homo sapiens
  misc_feature: HIJSMM301BA9TF.53.10.A10.1.454.light.4.raw
cgcgtatacacacgaccggtgctcgatttagcgtcgatctcaggggctgggcctcaggaagcagcatcggaggtgcctcagccatggcatggatccctctcttcctcggcgtccttgcttactgcacaggatccgtggcctcctatgagttgactcagccaccctcactgtccgtgtccccaggacagacagccaccatcacttgttctggagataaactggagaccaagtatatttgttggtatcaacagaggccaggcctgtcccctctgttggtcatgtatcaagataacaagcggccctctggcatccctgggcgattctctggctccaactctgggaacacagccactctgaccatcagcgggacccagactatggatgaggctgactattactgtcaggcatgggacagcgaaattgcggtgttcggcgggggaccaaactgaccgtcccaggtcagcccaaggctgccccctcggtcactctgttccccg

SEQ ID NO: 600035 - DNA, 491 bp, Homo sapiens; identical to SEQ ID NO: 535194
  misc_feature: HIJSMM301B8ZC8.26.78.H01.1.454.light.4.raw

SEQ ID NO: 600036 - DNA, 488 bp, Homo sapiens; identical to SEQ ID NO: 538291
  misc_feature: HIJSMM301DRK5O.19.71.G05.1.454.light.4.raw

SEQ ID NO: 600037 - DNA, 486 bp, Homo sapiens; identical to SEQ ID NO: 535290
  misc_feature: HIJSMM301BBJ9V.3.12.B01.1.454.light.4.raw

SEQ ID NO: 600038 - DNA, 492 bp, Homo sapiens; identical to SEQ ID NO: 577334
  misc_feature: HIJSMM301CUHEH.4.34.D01.1.454.light.4.raw

SEQ ID NO: 600039 - DNA, 493 bp, Homo sapiens; identical to SEQ ID NO: 540127
  misc_feature: HIJSMM301AV1BR.10.17.B06.1.454.light.4.raw

SEQ ID NO: 600040 - DNA, 496 bp, Homo sapiens
  misc_feature: HIJSMM301DZ6RJ.10.79.H02.1.454.light.4.raw
catagtagtgcacgaccggtgctcgatttagtgtcacacgaagggaaagggggagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccaggggaccaagctggagatacaaacgaactgtggctgcaccatctgtcttcta

SEQ ID NO: 600041 - DNA, 516 bp, Homo sapiens
  misc_feature: HIJSMM301DD4XI.8.87.H10.1.454.light.4.raw
ctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtaccagcagaagccaggccaggcccctgtactggtcatctttagcgattccaaccggccctctgggatccctgagcgattctctggctccaagtcgggaacacggcaccctgaccatcagcagggcccaacccttggatgagggtgactattctgtcaagtgtgggacaccaacacttgtgtcttcgggactgggaccgaggtcaccgtcctaagtcagcccagggccaaccccactgtcactctgttcccaccctccctcgacacg

SEQ ID NO: 600042 - DNA, 512 bp, Homo sapiens
  misc_feature: HIJSMM301EX8WH.5.27.C05.1.454.light.4.raw
atcagacacgcacgaccggtgctcgatttagacgcgatcgaagggtttgggagggtttgggaacctatgaacattctgtaggggccactttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccgccctcctccgtgtcctgat

SEQ ID NO: 600043 - DNA, 503 bp, Homo sapiens
  misc_feature: HIJSMM301BP01Z.47.82.H05.1.454.light.4.raw
agctcacgtacacgaccggtgctcgatttagtcgagctctctcgcgggtagaagtcacttatgagacacaccagtgtggccttgttggcttgaagctcctcaggaagcagcatcgggggtgccgcagccatggcctggaccgctctccttctgagcctccttgctcactttacagtttctgtggcctcctttgacctgactcagccactctcagtgtccgtggccctgggacagacggccagacttacctgtgggggaatcaacattggacgtaaaaatgtgcactggtaccaacagaagccaggccaggcccctgtcctggtcatctataaggatacaaaccggccctctgggatccctgaacgattctctggctccaattcggacaacacggccaccctgaccatcagcagagcccaagtcggagatgaggctgactatttctgtcaaatttgggacatctccgctgcggtattcggcgcagggaccaagctgaccgtcct

SEQ ID NO: 600044 - DNA, 485 bp, Homo sapiens; identical to SEQ ID NO: 535822
  misc_feature: HIJSMM301C6C2F.14.53.E09.1.454.light.4.raw

SEQ ID NO: 600045 - DNA, 488 bp, Homo sapiens; identical to SEQ ID NO: 537124
  misc_feature: HIJSMM301ADSCK.11.25.C03.1.454.light.4.raw

SEQ ID NO: 600046 - DNA, 460 bp, Homo sapiens; identical to SEQ ID NO: 539417
  misc_feature: HIJSMM301DXXLL.43.66.F11.1.454.light.4.raw

SEQ ID NO: 600047 - DNA, 506 bp, Homo sapiens; identical to SEQ ID NO: 542696
  misc_feature: HIJSMM301BOVTE.7.71.G05.1.454.light.4.raw

SEQ ID NO: 600048 - DNA, 507 bp, Homo sapiens; identical to SEQ ID NO: 559118
  misc_feature: HIJSMM301CZPSC.17.87.H10.1.454.light.4.raw

SEQ ID NO: 600049 - DNA, 505 bp, Homo sapiens
  misc_feature: HIJSMM301D9RJT.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggatccggtccgaggatgaggctgactattactgtgcatcacgggacgcaacatgggatgacaatctgagcggttgggtgttcggcggagggacccaaactggaccgttcctaggtcagcccaa

SEQ ID NO: 600050 - DNA, 494 bp, Homo sapiens; identical to SEQ ID NO: 599849
  misc_feature: HIJSMM301C7VJ6.13.6.A06.1.454.light.4.raw

SEQ ID NO: 600051 - DNA, 502 bp, Homo sapiens; identical to SEQ ID NO: 594947
  misc_feature: HIJSMM301CHM2T.4.39.D06.1.454.light.4.raw

SEQ ID NO: 600052 - DNA, 480 bp, Homo sapiens
  misc_feature: HIJSMM301E0DSB.40.81.H04.1.454.light.4.raw
tctagcgactcacgaccggtgctcgatttagtagtgtagattcgcggggctgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagattttacactgaaaatcagcagggtgaggcagaagatgttgggatttattactgcatgcaacctctacaaactgtgtggacggtcggccaagggaccaaggtggaaatcaagcgaa

SEQ ID NO: 600053 - DNA, 494 bp, Homo sapiens
  misc_feature: HIJSMM301BAJNF.41.37.D04.1.454.light.4.raw
tctatactatcacgaccggtgctcgatttagtagcatactgttgggtttgggggcaggagccagacccagtcaggacacagcatggacatgagggtccccgctcagctcctggggctcctgctgctctggttcccaggttccagatgcgacatccagatgacccagtctccatcttctgtgtctgcatctgtcggagacagagtcaccatcacttgtcgggcgagtcagggtattggcagctacttagtctggtatcaacaaaaaccagggaaagcccctaaactccttatttatggatcatccagtttacaaagtggggtcccatcaaggttcagcggcagtggatctgggacacatttcactctcactatcagcagcctgcagcctgaggattttgcgacttactattgtcaacaggctgacagttccctctcactttcgcggagggaccaaggttgagaccaaacgaactagtggctgcaccatctgtctt

SEQ ID NO: 600054 - DNA, 493 bp, Homo sapiens
  misc_feature: HIJSMM301C6SCG.5.57.F02.1.454.light.4.raw
atcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgttcggcccagggaccacatggatatcaggcgaaactgtggctgcaccatctgtctt

SEQ ID NO: 600055 - DNA, 485 bp, Homo sapiens
  misc_feature: HIJSMM301EJ8CQ.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagatttacgctgaaaatcagtagggtgaggctgaggatgttggggtttattactgcatgcaagttctacaaacttcctacacttttggccaggggaccaagctggagatcaaacgaa

SEQ ID NO: 600056 - DNA, 486 bp, Homo sapiens; identical to SEQ ID NO: 542999
  misc_feature: HIJSMM301B3I5C.17.55.E11.1.454.light.4.raw

SEQ ID NO: 600057 - DNA, 470 bp, Homo sapiens; identical to SEQ ID NO: 535302
  misc_feature: HIJSMM301DSS8J.13.76.G10.1.454.light.4.raw

SEQ ID NO: 600058 - DNA, 506 bp, Homo sapiens; identical to SEQ ID NO: 554189
  misc_feature: HIJSMM301DF4S6.19.78.H01.1.454.light.4.raw

SEQ ID NO: 600059 - DNA, 488 bp, Homo sapiens; identical to SEQ ID NO: 555641
  misc_feature: HIJSMM301A6W5R.51.6.A06.1.454.light.4.raw

SEQ ID NO: 600060 - DNA, 518 bp, Homo sapiens
  misc_feature: HIJSMM301EL907.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccatttttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctcggtcactctgttcccacctcctcacg

SEQ ID NO: 600061 - DNA, 489 bp, Homo sapiens; identical to SEQ ID NO: 541604
  misc_feature: HIJSMM301DPG28.22.86.H09.1.454.light.4.raw

SEQ ID NO: 600062 - DNA, 507 bp, Homo sapiens
  misc_feature: HIJSMM301BQJLN.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgtcgtccacgggacgacacgtagaatagagacgaacgtacgtggctgcaccatctgtcttctactcttcccgt

SEQ ID NO: 600063 - DNA, 496 bp, Homo sapiens
  misc_feature: HIJSMM301D3E5O.10.79.H02.1.454.light.4.raw
catagtagtgcacgaccggtgctcgatttagtgtcacacgaagggaaaggggggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccaggggaccaagctggagatcaaacgaactgtggctgcaccatctgtt

SEQ ID NO: 600064 - DNA, 511 bp, Homo sapiens
  misc_feature: HIJSMM301AUUMF.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgctaggtagtttaacacttaatgtctttcggtaattagggacgaacggtcaccgtcctaggtcagcccaaacggccaaccccta

SEQ ID NO: 600065 - DNA, 496 bp, Homo sapiens; identical to SEQ ID NO: 535109
  misc_feature: HIJSMM301ERVEL.16.78.H01.1.454.light.4.raw

SEQ ID NO: 600066 - DNA, 499 bp, Homo sapiens
  misc_feature: HIJSMM301B9TRK.49.26.C04.1.454.light.4.raw
agtcgagagacacgaccggtgctcgatttagtctagcgactttgggtttgggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccattagcagcctagagcctgaagattttgcagtctattactgtcagcagcgttacaactggcctcccatgtacacttttggccaggggaccaagctggaaatcagacgaactgtggctgcaccatctgtctt

SEQ ID NO: 600067 - DNA, 506 bp, Homo sapiens
  misc_feature: HIJSMM301AOHYV.48.67.G01.1.454.light.4.raw
agtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggccgtcccggccaggttcagtgccagtgggtctgggacagacttcactctcaccatcagcagcctagagcccgaagattttgcggtttattactgtcagcagcgtgccaactggcctctcacggttcggcggagggaccaaggtggacatcaaaacgactgtggctgcaccatctgtcttcatcttccccg

SEQ ID NO: 600068 - DNA, 512 bp, Homo sapiens
  misc_feature: HIJSMM301C6OIJ.17.33.C11.1.454.light.4.raw
  modified_base (425)..(425): a, c, t, g, unknown or other
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctacttttggnggtgctgtgctattcggcggagggaccaagctgaccgtcttaagtcagcccaaggctgccccctcggtcactctgtcccgccctcct

SEQ ID NO: 600069 - DNA, 486 bp, Homo sapiens; identical to SEQ ID NO: 535385
  misc_feature: HIJSMM301D1M8H.19.71.G05.1.454.light.4.raw

SEQ ID NO: 600070 - DNA, 486 bp, Homo sapiens
  misc_feature: HIJSMM301BCKD3.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatggttggggtttattactgcatgcaagttctacaacttcctacacttttggccagggaccaagctggagatcaaacgaa

SEQ ID NO: 600071 - DNA, 496 bp, Homo sapiens
  misc_feature: HIJSMM301DAJ3S.13.10.A10.1.454.light.4.raw
tcacgtactacacgaccggtgctcgatttagcgtcgatctcagggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttgggaacaaagctgcccttatcatcacggggcccaggcagaagatgaatctgattattactgtgttctttatatggtagtgccatttctgctgtgttcggaggaggcacccggctgaccgtcctcggtcagcccaaggctgccccc

SEQ ID NO: 600072 - DNA, 449 bp, Homo sapiens; identical to SEQ ID NO: 566470
  misc_feature: HIJSMM301ARJZV.18.9.A09.1.454.light.4.raw

SEQ ID NO: 600073 - DNA, 481 bp, Homo sapiens; identical to SEQ ID NO: 539249
  misc_feature: HIJSMM301APSS5.11.76.G10.1.454.light.4.raw

SEQ ID NO: 600074 - DNA, 490 bp, Homo sapiens; identical to SEQ ID NO: 551555
  misc_feature: HIJSMM301AKHG9.10.72.G06.1.454.light.4.raw

SEQ ID NO: 600075 - DNA, 514 bp, Homo sapiens; identical to SEQ ID NO: 547648
  misc_feature: HIJSMM301CMEJT.16.1.A01.1.454.light.4.raw

SEQ ID NO: 600076 - DNA, 492 bp, Homo sapiens
  misc_feature: HIJSMM301BC9W6.40.71.G05.1.454.light.4.raw
  modified_base (471)..(471): a, c, t, g, unknown or other
tctagcgactcacgaccggtgctcgatttagtgtcgtcgcaagagagagggggaagctctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccgggacagaaggtcaccatctcctgctctggaagcagctccaacattgggaaaaattatgtatcctggtaccagcagctcccaggaacagcccccaaactcctcatttatgacaataataagcgaccctcagggattcctgaccgattctctggctccaagtctggcacgtcagccaccctgggcatcaccggactccagactggcgacgaggccgtttattattgcggaacatgggatagcggcctgagtgatgagtggatgtcggnggcggaccaaactgaccgtct

SEQ ID NO: 600077 - DNA, 474 bp, Homo sapiens
  misc_feature: HIJSMM301CQNL3.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacttttggcgggggaccaaggtggacatcaaacgaactc

SEQ ID NO: 600078 - DNA, 506 bp, Homo sapiens
  misc_feature: HIJSMM301DD0GD.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaaacagttttctcggggcgttcggtccaagggaccaaggtggaaatcaaacgaactagtggctgcaccatctgtcttcatcttccccg

SEQ ID NO: 600079 - DNA, 506 bp, Homo sapiens
  misc_feature: HIJSMM301AE9J5.48.34.D01.1.454.light.4.raw
agtatacatacacgaccggtgctcgatttagatcgtctgtgttgggtttgggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagccaaggctgccccctcggtcactctgtt

SEQ ID NO: 600080 - DNA, 511 bp, Homo sapiens; identical to SEQ ID NO: 544123
  misc_feature: HIJSMM301CXMCE.5.27.C05.1.454.light.4.raw

SEQ ID NO: 600081 - DNA, 506 bp, Homo sapiens
  misc_feature: HIJSMM301AWUE6.18.59.F04.1.454.light.4.raw
tacgagtatgcacgaccggtgctcgatttagtacacacacttagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggcccaaccccca

SEQ ID NO: 600082 - DNA, 488 bp, Homo sapiens; identical to SEQ ID NO: 535990
  misc_feature: HIJSMM301CJT1I.11.28.C06.1.454.light.4.raw

SEQ ID NO: 600083 - DNA, 504 bp, Homo sapiens; identical to SEQ ID NO: 538940
  misc_feature: HIJSMM301BNH1W.2.35.D02.1.454.light.4.raw

SEQ ID NO: 600084 - DNA, 486 bp, Homo sapiens
  misc_feature: HIJSMM301D0NZA.41.57.F02.1.454.light.4.raw
tctatactatcacgaccggtgctcgatttagctcgatatagttgggtttggggtccaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacagctacaatgttggcaacgaaggagcagcttggctgcagcagtaccagggccaccctcccaaattgctatcatacagaagaacaaccgcccctcggggatctccgagagattctctgcatcaacgtcaggaaacatagcctccctgaccattactggactccagcctgaggacgaggctgactattactgctcagcatgggacagcagcctcaatgttgggtgttcggcggagggaccaaggctgaccgtcctaggtcacg

SEQ ID NO: 600085 - DNA, 503 bp, Homo sapiens; identical to SEQ ID NO: 568855
  misc_feature: HIJSMM301A00JS.9.71.G05.1.454.light.4.raw

SEQ ID NO: 600086 - DNA, 484 bp, Homo sapiens
  misc_feature: HIJSMM301CNQK2.21.4.A04.1.454.light.4.raw
tcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccagcagaagcctggccaggctcccaggttcctcatctatgctgggtcccacagggccactggcatcccagacaggttcagtggcaggtgggtctgggacagacttcactctcatcattagcagactggagcctgaagatttcgcagtgtattactgtcagcagtatggagttcacctctgtcgttcggccaaggaccaaggtagaatgaaacgaactgtggctgcaccat

SEQ ID NO: 600087 - DNA, 497 bp, Homo sapiens; identical to SEQ ID NO: 543223
  misc_feature: HIJSMM301ER0TA.43.39.D06.1.454.light.4.raw

SEQ ID NO: 600088 - DNA, 488 bp, Homo sapiens
  misc_feature: HIJSMM301EBXEF.10.2.A02.1.454.light.4.raw
catagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtggccaggctcccaggctcctcgtatatggtgcaatccaccagggccactggtatctcaggcaggttccgtggcagtgggtctgggacagagttcactgtcaccatcagcagcctgcagtctgaagattttgcagtttattactgtcagcagtataatagctggcccgcgacgttcggccaaggaccgaggtggaagttcaaacgaaactgtggctgcaccatctgtctt

SEQ ID NO: 600089 - DNA, 490 bp, Homo sapiens
  misc_feature: HIJSMM301DLJNU.43.34.D01.1.454.light.4.raw
tgtgagtagtcacgaccggtgctcgatttagatcgtctgtgttgggtttggggagagctgctcagttaggacccagagggaaccatggaaaccccagcgcagcttctcttcctcctgctactctggctcccagataccaccggagaaattgtgttgacacagtctccaggcaccctgtctttgtctccaggggacagaggcaccctctcctgcagggccagtcagactgttagcagcagcagcttagcctggtaccagcagaaacctggccaggctcccaggctcctcatctatggtacatccaacagggccactggcataccagacaggttcagtggcagcgggtctgggacagacttcactctcaccatcagcagactggagcctgaagattttgcagtgtattactgtcagcagtatggtagctcacaggggacgttcgaccaagggacccaaaggtggaaaatcaaacgaactgtggctgcaccat

SEQ ID NO: 600090 - DNA, 489 bp, Homo sapiens
  misc_feature: HIJSMM301D0HWI.47.46.E02.1.454.light.4.raw
agctcacgtacacgaccggtgctcgatttagactcatctacagggaaaggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactcggtttcccagccaggttcagtggcagtgcgtctgggacagagttcactctcaccatcaacagcctgcagtctgaagattttgcagtttattactgtcagcagtatcataactggccgctccaccttccggccgaagggaccacgactggagattaaacgaactgtggctgcaccat

SEQ ID NO: 600091 - DNA, 472 bp, Homo sapiens
  misc_feature: HIJSMM301BSJMY.48.73.G07.1.454.light.4.raw
agtatacatacacgaccggtgctcgatttagctctacgctcagggcacgaccggtgctcgatttagagtgctacgaagggaaaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttatcactatgtctcctggtaccaacagcaccctggcaaagcccccaaactcatgatttatgatatcactaagcggccctcaggggtccctgatcgcttctctggctccaagtctggcaacacggcctcctgaccatctctgggctccaggctgaggatggaggctgattattactgctgctcatatgcaggcagcct

SEQ ID NO: 600092 - DNA, 510 bp, Homo sapiens
  misc_feature: HIJSMM301BA6A6.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcgggcgttcggccaacgggaccgaaggtaggaaatacaaacgaactagtggctgcaccactctgtcttctatcttccccg

SEQ ID NO: 600093 - DNA, 495 bp, Homo sapiens
  misc_feature: HIJSMM301BZQZ3.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacacccttcggccaagggacacgactggagattaaaggaactgtggctgcaccatctgtcttcatcttccccg

SEQ ID NO: 600094 - DNA, 518 bp, Homo sapiens; identical to SEQ ID NO: 539372
  misc_feature: HIJSMM301CH2MF.7.86.H09.1.454.light.4.raw

SEQ ID NO: 600095 - DNA, 518 bp, Homo sapiens; identical to SEQ ID NO: 539372
  misc_feature: HIJSMM301EET75.7.86.H09.1.454.light.4.raw

SEQ ID NO: 600096 - DNA, 444 bp, Homo sapiens; identical to SEQ ID NO: 535027
  misc_feature: HIJSMM301CLZRU.8.73.G07.1.454.light.4.raw

SEQ ID NO: 600097 - DNA, 515 bp, Homo sapiens
  misc_feature: HIJSMM301CGVT9.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgttcgccacgggaccgacacgtagaaagtagagacgaactagtggcgtcggcaccactctgtcttctatcttcccgtcccc

SEQ ID NO: 600098 - DNA, 508 bp, Homo sapiens; identical to SEQ ID NO: 560800
  misc_feature: HIJSMM301DKLGS.17.33.C11.1.454.light.4.raw

SEQ ID NO: 600099 - DNA, 522 bp, Homo sapiens
  misc_feature: HIJSMM301D1RCT.41.87.H10.1.454.light.4.raw
tctatactatcacgaccggtgctcgatttagcagtactgcgttgggtttggggtggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtaacgttggcggttataactatgtctcctggtaccaacaacacccaggcaaagtccccaaactcataatttatgaggtctctaagcggccctcaggggtccctggtcgcttctctggctccaagtttggcaacacggcctcctgaccgtctctgggctccagagtgaagatgaggctgattactactgcgcctcatatgcaggcagcaacaatttcagggtatttggcggagggaccaagctgaccgtcctgggtcagcccaaggctgccccctggtcactctcgttcccccg

SEQ ID NO: 600100 - DNA, 482 bp, Homo sapiens
  misc_feature: HIJSMM301AOVZS.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaggctgattattactgctcagcatggacaccggcctcagtgcgtgggttttcggcggaggaccaagctgaccgtcctaggtcagacccg

SEQ ID NO: 600101 - DNA, 503 bp, Homo sapiens; identical to SEQ ID NO: 587033
  misc_feature: HIJSMM301DGYTF.5.86.H09.1.454.light.4.raw

SEQ ID NO: 600102 - DNA, 510 bp, Homo sapiens
  misc_feature: HIJSMM301EYVPK.5.59.F04.1.454.light.4.raw
atcagacacgcacgaccggtgctcgatttagtacacacacttagggattggggctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgttcggtccaaggaccgaacggtaggaaagtacaaacgaactagtggctgcaccactctgtcttctatcttccgtcccta

SEQ ID NO: 600103 - DNA, 507 bp, Homo sapiens
  misc_feature: HIJSMM301BOIX3.27.78.H01.1.454.light.4.raw
  modified_base (499)..(499): a, c, t, g, unknown or other
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttccaccctcaccatcaatagcctggaagctgaagatgctgcaacttattactgtcatcagagttactactttacctacaagtgatcaccttcggccaagggacacgactagganattaaacg

SEQ ID NO: 600104 - DNA, 464 bp, Homo sapiens
  misc_feature: HIJSMM301ANFI7.10.9.A09.1.454.light.4.raw
catagtagtgcacgaccggtgctcgatttagcgagacgcgcagggggaggaactgctcagttaggacccagagggaaccatggaagccccagctcagcttctcttcctcctgctactctggctcccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagttttattactgtcaacatcgtaccgagtggcctccgggggccactttcggccctgggaccaaagtggagatcaaacgaactgtggctgcaccatctgtcttcatctttccgccatctgacactactatg

SEQ ID NO: 600105 - DNA, 494 bp, Homo sapiens
  misc_feature: HIJSMM301AYAY0.51.14.B03.1.454.light.4.raw
cgatcgtatacacgaccggtgctcgatttagtgtgagtagttccgcgggggcaggagtcagaccccgtcaggacacagcatggacatgagggtccccgctcagctcctggggctcctgctgctctggttcccaggttccagatgcgacatccagatgacccagtctccatcctccgtgtctgcatctgtaggagacagagtcaccatgacttgtcgagcgagtcagggtattgacgactacttagcctggcttcagcagaaaccagggaaagcccccaagctcttgatctatgctgcatccaggttggaaagtggggtcccatcaaggttcagcggcagtggatctgggacagatttcactctcaccatcagcagcctgcagcctgaagattttgcaacttattattgtcaacaggctaaaagttacccctctcactttcggcggagggaccaaggtagaaaccaaacgaactagtggctgcaccatctgtctt

SEQ ID NO: 600106 - DNA, 488 bp, Homo sapiens; identical to SEQ ID NO: 572737
  misc_feature: HIJSMM301BFV1U.5.40.D07.1.454.light.4.raw

SEQ ID NO: 600107 - DNA, 493 bp, Homo sapiens
  misc_feature: HIJSMM301C7ASE.51.6.A06.1.454.light.4.raw
cgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacatagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtggtacttatgtcttcggaactgggaccaaggtcaccgtcctaggtcagcccaaggccaaccccactgtcactctcg

SEQ ID NO: 600108 - DNA, 489 bp, Homo sapiens
  misc_feature: HIJSMM301BXKSO.40.71.G05.1.454.light.4.raw
tctagcgactcacgaccggtgctcgatttagtgtcgtcgcaagagagaggggcacgaccggtgctcgatttagtgtcgtcgcaagagagagggggaagctctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccgggacagaaggtcaccatctcctgctctggaagcagctccaacattgggaaaaattatgtatcctggtaccagcagctcccaggaacagcccccaaactcctcatttatgacaataataagcgaccctcagggattcctgaccgattctctggctccaagtctggcacgtcagccaccctgggcatcaccggactccagactggcgacgaggccgtttattattgcggaacatgggatagcgg

SEQ ID NO: 600109 - DNA, 507 bp, Homo sapiens; identical to SEQ ID NO: 535641
  misc_feature: HIJSMM301EUGVO.10.88.H11.1.454.light.4.raw

SEQ ID NO: 600110 - DNA, 522 bp, Homo sapiens
  misc_feature: HIJSMM301CA1V8.9.38.D05.1.454.light.4.raw
tgatacgtctcacgaccggtgctcgatttagtatctgatagttgggtttggggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaagccccaaactcttgctttatgatgtcagttatcggccctcaggagtttctgatcgcttctctggctccaagtctggcaccacggcctccctgaccatctctgggctccaggctgaggacgaggctgattatttcttgcagctcaaaagaagtagccctctcgtggttttcggtcggggggaccaaggtgaccgtcctaagtcagcccaaggctgccccctcggtcactctgttcccaccctcctc

SEQ ID NO: 600111 - DNA, 485 bp, Homo sapiens; identical to SEQ ID NO: 542735
  misc_feature: HIJSMM301D4XNI.26.45.E01.1.454.light.4.raw

SEQ ID NO: 600112 - DNA, 496 bp, Homo sapiens; identical to SEQ ID NO: 588432
  misc_feature: HIJSMM301CUVDL.12.37.D04.1.454.light.4.raw

SEQ ID NO: 600113 - DNA, 494 bp, Homo sapiens; identical to SEQ ID NO: 534992
  misc_feature: HIJSMM301BTTKX.9.1.A01.1.454.light.4.raw

SEQ ID NO: 600114 - DNA, 513 bp, Homo sapiens; identical to SEQ ID NO: 566998
  misc_feature: HIJSMM301DCKH4.17.37.D04.1.454.light.4.raw

SEQ ID NO: 600115 - DNA, 491 bp, Homo sapiens; identical to SEQ ID NO: 535176
  misc_feature: HIJSMM301EKNYU.13.39.D06.1.454.light.4.raw

SEQ ID NO: 600116 - DNA, 478 bp, Homo sapiens
  misc_feature: HIJSMM301DVF6U.21.25.C03.1.454.light.4.raw
tcgtcgctcgcacgaccggtgctcgatttagtagtgtagatttgggtttgggggctgttcctgggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgcagtcctatgacaacaccctgcgtggttttggctgtcggcggcggac

SEQ ID NO: 600117 - DNA, 486 bp, Homo sapiens
  misc_feature: HIJSMM301EGN34.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgaggtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgccccaaccttcggccagggacacgactggagattaaacgaactagtggctgcaccatctgtt

SEQ ID NO: 600118 - DNA, 503 bp, Homo sapiens; identical to SEQ ID NO: 557965
  misc_feature: HIJSMM301DP1NL.8.28.C06.1.454.light.4.raw

SEQ ID NO: 600119 - DNA, 496 bp, Homo sapiens
  misc_feature: HIJSMM301ENQWQ.40.12.B01.1.454.light.4.raw
tctagcgactcacgaccggtgctcgatttagtagtgtagattccgcggggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgccagaagccagggcagtctccacagctcttgatatattggggttcttatcggcctccggggtccctgacaggttcagtggcagtggatcagtcacagattttacactgaaaatcaagcagggtggaggcagaagatgttgggatttattactgcatgcaacctctacaaactgtgtggacggtcggccaagggaccaaggtcggaaatcaagcgaactgtggctgcacc

SEQ ID NO: 600120 - DNA, 509 bp, Homo sapiens
  misc_feature: HIJSMM301B0A5N.5.60.F05.1.454.light.4.raw
atcagacacgcacgaccggtgctcgatttagtacgtcatcagggaaagggtagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcacctcagcctccctggccatccgtgggctccagtctgaggatgagtctgattattactgtgcaacatgggatgacagcctgaatggtccggtattcggcggagggaccaagctgaccgtcctcggtcagcccaaggcctgccccctc

SEQ ID NO: 600121 - DNA, 503 bp, Homo sapiens; identical to SEQ ID NO: 538884
  misc_feature: HIJSMM301AU2U6.27.78.H01.1.454.light.4.raw

SEQ ID NO: 600122 - DNA, 486 bp, Homo sapiens; identical to SEQ ID NO: 535043
  misc_feature: HIJSMM301CFCDV.46.35.D02.1.454.light.4.raw

SEQ ID NO: 600123 - DNA, 498 bp, Homo sapiens
  misc_feature: HIJSMM301BWZ3G.11.67.G01.1.454.light.4.raw
cgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccaccctcagcgtctgggacccccgggcagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctggcacctcagcctccctggcctgcagtgggctccagtctgaggatgaggctgactattattgtgcagcgtgggatgacggtctgagtgctgtggtcttcggcggagggaccaagctgaccgtctgggtcagcccaa

SEQ ID NO: 600124 - DNA, 484 bp, Homo sapiens
  misc_feature: HIJSMM301AWCVL.52.78.H01.1.454.light.4.raw
cgcagtacgacacgaccggtgctcgatttagtgtgagtagtttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacgtatccctgatcgcttctcaggctccggctctgggactgagcgctacctcaccatctccagcctccagtctgaggacgagggtgactattactgtcagacgtgggacactggcagtttgggtgttcggcggagggaccaagttcgaccgtcctaggtcagcccaaggct

SEQ ID NO: 600125 - DNA, 505 bp, Homo sapiens; identical to SEQ ID NO: 546412
  misc_feature: HIJSMM301EQLJT.22.21.B10.1.454.light.4.raw

SEQ ID NO: 600126 - DNA, 479 bp, Homo sapiens
  misc_feature: HIJSMM301BQJZM.13.5.A05.1.454.light.4.raw
tcacgtactacacgaccggtgctcgatttagatagatagacaggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagaaatggatatacctatttggattggtatctgcagaagccagggcagtctccacaactcctgatctattggggttctaatcgggcctccggggtccctgacaggttcagtggcagtggatcaggcacagattttacactgaaaatcagcagagtggaggctgaggatgttggggtttattactgcatgcaagctctacaaactctgcggactttcggccctgggaccaaagtggagatcaaacgaa

SEQ ID NO: 600127 - DNA, 492 bp, Homo sapiens
  misc_feature: HIJSMM301BQ6IV.47.55.E11.1.454.light.4.raw
agctcacgtacacgaccggtgctcgatttagcactcgcacgttgggtttggggagagagaccccctcccctgggatcctgcagctccaggctcccgtgggtggggttagagttgggaacctatgaacattctgtaggggccactgtcttctccacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagcccaaggccaaccccactgtcactctgttcccaccctcctctacgtgagct

SEQ ID NO: 600128 - DNA, 486 bp, Homo sapiens; identical to SEQ ID NO: 535385
  misc_feature: HIJSMM301APN9U.19.71.G05.1.454.light.4.raw

SEQ ID NO: 600129 - DNA, 508 bp, Homo sapiens
  misc_feature: HIJSMM301BR7GB.14.7.A07.1.454.light.4.raw
cgtctagtaccacgaccggtgctcgatttagcacgtgtcgcagggggccctgaggaaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtcttttggggtccctgatcgcttctctggctccatccttgggaacaaggctgccctcaccatcacgggggcccaggcagatgatgaatctaattatcactgtgcgttgtatatgggttttggtcatttcggtgttcggcggagggacccaggtgacgtcctacgtcagccc

SEQ ID NO: 600130 - DNA, 498 bp, Homo sapiens; identical to SEQ ID NO: 549310
  misc_feature: HIJSMM301CV9FA.12.86.H09.1.454.light.4.raw

SEQ ID NO: 600131 - DNA, 503 bp, Homo sapiens; identical to SEQ ID NO: 536834
  misc_feature: HIJSMM301B1D7J.2.35.D02.1.454.light.4.raw

SEQ ID NO: 600132 - DNA, 515 bp, Homo sapiens
  misc_feature: HIJSMM301CHSWT.13.38.D05.1.454.light.4.raw
tcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggtcctaacggaccgaacggtaggaagtacaagacgaacgtagtaggcgtgcgacactctcgtcttctatcttccgt

SEQ ID NO: 600133 - DNA, 501 bp, Homo sapiens; identical to SEQ ID NO: 535873
  misc_feature: HIJSMM301BWSFW.17.27.C05.1.454.light.4.raw

SEQ ID NO: 600134 - DNA, 470 bp, Homo sapiens; identical to SEQ ID NO: 535302
  misc_feature: HIJSMM301DUSNO.13.76.G10.1.454.light.4.raw

SEQ ID NO: 600135 - DNA, 489 bp, Homo sapiens; identical to SEQ ID NO: 535139
  misc_feature: HIJSMM301A2I7G.14.55.E11.1.454.light.4.raw

SEQ ID NO: 600136 - DNA, 482 bp, Homo sapiens
  misc_feature: HIJSMM301E3I5Y.49.35.D02.1.454.light.4.raw
agtcgagagacacgaccggtgctcgatttagcacacgatagttgggtttgggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttctaccatcagcaggctgcagcctgaagatattgcaacatattactgtcaacagtatgatagtctcccgctcactttcggtcggggggaccggaaggaggaggatcaagacgactacgtgg

SEQ ID NO: 600137 - DNA, 459 bp, Homo sapiens
  misc_feature: HIJSMM301B66ID.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaaggctgccccctcggtcactctgttcccaccctcctcacgctatgt

SEQ ID NO: 600138 - DNA, 496 bp, Homo sapiens
  misc_feature: HIJSMM301C9SWJ.2.49.E05.1.454.light.4.raw
acgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagagcggccccaagctcctcatctatagaaattatgaacggtcctcaggggtccctgaccgattctctggctccaagtctggcacctcagcctccctggccatcagtgggctccggtccgaggatgaggctgattattactgtgttggatgggacagcagcctgagtgcttatgtcttcggaactgggaccacggtcaccgtcct

SEQ ID NO: 600139 - DNA, 502 bp, Homo sapiens; identical to SEQ ID NO: 543913
  misc_feature: HIJSMM301B92IQ.18.26.C04.1.454.light.4.raw

SEQ ID NO: 600140 - DNA, 508 bp, Homo sapiens
  misc_feature: HIJSMM301B6E57.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttggccaagggaccgaacggtaggaaatacaacgaactagtggctcgcaccactctgtcttctatcttccccg

SEQ ID NO: 600141 - DNA, 454 bp, Homo sapiens; identical to SEQ ID NO: 534964
  misc_feature: HIJSMM301C9VQL.19.86.H09.1.454.light.4.raw

SEQ ID NO: 600142 - DNA, 498 bp, Homo sapiens; identical to SEQ ID NO: 535469
  misc_feature: HIJSMM301BC3UI.12.18.B07.1.454.light.4.raw

SEQ ID NO: 600143 - DNA, 493 bp, Homo sapiens
  misc_feature: HIJSMM301DS168.41.67.G01.1.454.light.4.raw
tctatactatcacgaccggtgctcgatttagagtatacatattgggtttgggggagctctggggagtctgcaccatggcttggaccccactcctcttcctcaccctcctcctccactgcacagggtctctctcccagcttgtgctgactcaatcgccctctgcctctgcctccctgggaacctcggtcaagctcacctgcactctgagcagtggagacagcagacacgccatcgcatggcatcagcagcagccaggaaggggccctcgattcctgatgaaacttacttttgatggcagccacaccaagggggacgggatccctgatcgcttctcaggctccagctctggggctgagcgctacctttcgatctccagcctccagtctgaggatgaggctgactattactgtcagtcctgggacaggggcgttttggtgttcggcggagggaccagactgaccgtcctgggtcagccaaggctcgccccctcggt

SEQ ID NO: 600144 - DNA, 486 bp, Homo sapiens; identical to SEQ ID NO: 535043
  misc_feature: HIJSMM301D8UQV.46.35.D02.1.454.light.4.raw

SEQ ID NO: 600145 - DNA, 502 bp, Homo sapiens; identical to SEQ ID NO: 541971
  misc_feature: HIJSMM301EL8O1.4.39.D06.1.454.light.4.raw

SEQ ID NO: 600146 - DNA, 502 bp, Homo sapiens; identical to SEQ ID NO: 543936
  misc_feature: HIJSMM301AO1KA.15.1.A01.1.454.light.4.raw

SEQ ID NO: 600147 - DNA, 491 bp, Homo sapiens
  misc_feature: HIJSMM301E1KW7.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgaggggtgattattactgcagctcatatagaagtggcagcactctcgtattcggcggtgggaccaagctgaccgtcctaggtcagccc

SEQ ID NO: 600148 - DNA, 490 bp, Homo sapiens; identical to SEQ ID NO: 535526
  misc_feature: HIJSMM301D0ANJ.26.78.H01.1.454.light.4.raw

SEQ ID NO: 600149 - DNA, 497 bp, Homo sapiens; identical to SEQ ID NO: 545672
  misc_feature: HIJSMM301DHB26.2.49.E05.1.454.light.4.raw

SEQ ID NO: 600150 - DNA, 493 bp, Homo sapiens
  misc_feature: HIJSMM301AQCJG.41.23.C01.1.454.light.4.raw
tctatactatcacgaccggtgctcgatttagtacacgtgattagggattgggggtgggtccaggaggcagaactctgggtgtctcaccatggcctggatccctctacttctccccctcctcactctctgcacaggctctgtgacctcctatgagctgacacagccaccctcggtgtcagtgtccccaggacagacggccaggatcgactgctctggagaagcattggcaacggaatatgcttattggtaccagcagaagccaggtcaggcccccatgttaataatatatagagacagtgagaggccctcagggatacctgagcgtatgtctggctccagctcagggacaacagtcacgttgaccatcactggagtccaggcagaagacgaggctgactatcactgtcaatcagcagacagtagtggttcgttattgggtgttcggcggagggaccaagctgaccgtccttggtcagcccaaggctgccccctc

SEQ ID NO: 600151 - DNA, 485 bp, Homo sapiens; identical to SEQ ID NO: 536040
  misc_feature: HIJSMM301AQI35.15.1.A01.1.454.light.4.raw

SEQ ID NO: 600152 - DNA, 495 bp, Homo sapiens; identical to SEQ ID NO: 550081
  misc_feature: HIJSMM301D41O8.43.39.D06.1.454.light.4.raw

SEQ ID NO: 600153 - DNA, 522 bp, Homo sapiens
  misc_feature: HIJSMM301B2AI7.27.23.C01.1.454.light.4.raw
agcgtcgtctcacgaccggtgctcgatttagtacacgtgattagggagttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtccactctgttcccgccct

SEQ ID NO: 600154 - DNA, 483 bp, Homo sapiens
  misc_feature: HIJSMM301DT6JG.48.35.D02.1.454.light.4.raw
agtatacatacacgaccggtgctcgatttagcacacgatagttgggtttgggggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcacttgccgggcaagtcaggacattaaaagtgatttagcctggtatcagcagaaaccagggagagcccctaagctcctcatctatgctgcttccattttacaaagtggagtctcatcaaggttcagcggcggtggatctggcacagatttcactctcaccatcagcagcctgcagcctgaagattttgcaacttattactgtctgcacgattacaattaccctcggacgttcggccaaggaccgaaggtggaagtcaaacgaactgtggctgcacca

SEQ ID NO: 600155 - DNA, 493 bp, Homo sapiens
  misc_feature: HIJSMM301AEBTQ.19.83.H06.1.454.light.4.raw
  modified_base (457)..(457): a, c, t, g, unknown or other
tactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactgaaaatcaacagagtggaggctgaggatgttggggtttattactgcatgcaagctctacaaactccctcaacgttcggcggagggaccaaggtggngatcaaacgaactgtggctgcaccatctgtcttcta

SEQ ID NO: 600156 - DNA, 504 bp, Homo sapiens
  misc_feature: HIJSMM301DG2GS.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaaccg

SEQ ID NO: 600157 - DNA, 514 bp, Homo sapiens
  misc_feature: HIJSMM301ADGH1.48.81.H04.1.454.light.4.raw
agtatacatacacgaccggtgctcgatttagtagtgtagattcgcgggagctctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtaaccatctcctgctctggaagtagttccaacattgggaataattatgtctcctggtatcagcaactcccaggaacagcccccaaactcctcatttatgacaataataagcgaccctcaggaattcctgaccgattctctggctccaagtctggcacgtcagccaccctgggcatcaccggactccagactggggacgaggccgattattactgcggaacatgggataacagcccgagtggtggccgggtcttcggcggagggaccaagctgaccgtcctacgtcagcccaaggctgtccccccg

SEQ ID NO: 600158 - DNA, 502 bp, Homo sapiens
  misc_feature: HIJSMM301B2K6H.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgacttttcggcggagggaccaagctgaccgtcctgggtcagcccaaggctgccccctggtcta

SEQ ID NO: 600159 - DNA, 507 bp, Homo sapiens; identical to SEQ ID NO: 538063
  misc_feature: HIJSMM301BL5QQ.47.85.H08.1.454.light.4.raw

SEQ ID NO: 600160 - DNA, 510 bp, Homo sapiens
  misc_feature: HIJSMM301DFIQV.48.66.F11.1.454.light.4.raw
agtatacatacacgaccggtgctcgatttagtcacgcgagaagggcttgatgccttggggaagcctgagaacacttagccttcatgagtgtccccaccatggcctggatgatgcttctcctcggactccttgcttatggatcaggcgtgcattctcagagtgtggtgacccaggaaccatcgttctcagtgtcccctggagggacagtcacactcacttgtggcttgacttctggctcagtcgcgccggtccactaccccagttggtaccaacagatcccaggccaggctccacgcacgctcatcttcatgaaacagattcgctcttctggggtccctgatcggttttctggctccatcgttgggggcaaagccgccctcaccatcacgggggcccaggcagaggatgaggcgaattattattgtatgctccacagggggcaggggcacctgggagttcgggcggcgggaccaagctgaccgtcctaggtcagcccaaggctgccccctc

SEQ ID NO: 600161 - DNA, 515 bp, Homo sapiens
  misc_feature: HIJSMM301AQ7ZZ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggtccgaagggaccgaaggtaggaaagtacaaacgaaactacgtggctgcaccactctgtcttctatctttccccg

SEQ ID NO: 600162 - DNA, 501 bp, Homo sapiens
  misc_feature: HIJSMM301BPZR8.10.68.G02.1.454.light.4.raw
catagtagtgcacgaccggtgctcgattagtcgatagtgaagggaaagggggtgtgggctcaggaggcagagctctgggaatctcaccatggcctggacccctctcctgctccccctcctcactttctgcacagtctctgaggcctcgtatgaactgacacagccaccctcggtgtcagtgtccccaggacagactgccaggatcagctgctctggagatgcatttgccaacaaaaatatgcttattggtacgagcaaaaagccaggccaggcccctgtcttgttgatatatgaggacacctaagcgaccctccggaatttctgagagattctccggctccagctcagggacagtggcctccttgactatcagtggggcccaggggtcgatgaggctgactactactgtttctcgactgacttcactggtaaacgttggctgttcggcggaggaccaagctgaccggcctgcgtcagcccaaggctgccccctcggtcact

SEQ ID NO: 600163 - DNA, 485 bp, Homo sapiens; identical to SEQ ID NO: 579022
  misc_feature: HIJSMM301EYKBK.7.75.G09.1.454.light.4.raw

SEQ ID NO: 600164 - DNA, 514 bp, Homo sapiens
  misc_feature: HIJSMM301CDLUJ.5.58.F03.1.454.light.4.raw
atcagacacgcacgaccggtgctcgatttagtctgatcgagaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcggggactgggaccaaggtcaccgtcctaggtcagcccaaggccaaccccactgtcactctccg

SEQ ID NO: 600165 - DNA, 496 bp, Homo sapiens
  misc_feature: HIJSMM301D0T85.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcacatcagcagcctagacgcctagaagtattttgctactttattactgtcagcagcgtagcaactcggcctctcctacgtttcgggcgggacgggaccgaggggtggagatcgagacgaa

SEQ ID NO: 600166 - DNA, 515 bp, Homo sapiens
  misc_feature: HIJSMM301EG4GC.48.53.E09.1.454.light.4.raw
agtatacatacacgaccggtgctcgatttagagagagtgtgttgggtttgggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtccaggccaggcccctgtcctggtcatttatgaggacgaccagcgaccctccaggatccctgcgaggttctctggatcgaactcagggacattggccaccttgactatcactgggcccaggtggaggatgaaggtgactacttctgtttctcaacagacaccagtgacaatcatgcgattttcggcggagggaccaagctgaccgtcctcgggtcagcccaaggcctcgcccccgtcggtcctactcctcgtt

SEQ ID NO: 600167 - DNA, 521 bp, Homo sapiens; identical to SEQ ID NO: 539470
  misc_feature: HIJSMM301AFY0T.27.23.C01.1.454.light.4.raw

SEQ ID NO: 600168 - DNA, 516 bp, Homo sapiens; identical to SEQ ID NO: 547464
  misc_feature: HIJSMM301AOMDC.49.17.B06.1.454.light.4.raw

SEQ ID NO: 600169 - DNA, 497 bp, Homo sapiens; identical to SEQ ID NO: 545672
  misc_feature: HIJSMM301CS6XL.2.49.E05.1.454.light.4.raw

SEQ ID NO: 600170 - DNA, 507 bp, Homo sapiens
  misc_feature: HIJSMM301BWZ6B.52.78.H01.1.454.light.4.raw
cgcagtacgacacgaccggtgctcgatttagtgtgagtagtttgggtttgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgcagtttattactgtcagcagcgtagcaactggcctccgatcaccttcggccaagggacacgactggagattaaacgaactgtggctgcaccatctgtcttcatcttccccg

SEQ ID NO: 600171 - DNA, 502 bp, Homo sapiens
  misc_feature: HIJSMM301C5W2H.19.78.H01.1.454.light.4.raw
tactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtcactctcgttccccacccctcctccacgagagta

SEQ ID NO: 600172 - DNA, 507 bp, Homo sapiens; identical to SEQ ID NO: 588234
  misc_feature: HIJSMM301BYWHZ.19.78.H01.1.454.light.4.raw

SEQ ID NO: 600173 - DNA, 511 bp, Homo sapiens
  misc_feature: HIJSMM301A307X.13.3.A03.1.454.light.4.raw
tcacgtactacacgaccggtgctcgatttagagagcgtcacaggggggggtcgacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaactcattatttacggggtcaataagcggccctcagggctttctgatcgcttctctggctccaagtctggcaacacggcctccctgacaatctctggactccaggccgaggacgaggctgatttttactgttgttcatatgcaggaaggagtgattatgtctttggaagtgggaccaaggtcaccgtccttggtcagcccaaggccaaccccactgtcactctgttcccg

SEQ ID NO: 600174 - DNA, 497 bp, Homo sapiens
  misc_feature: HIJSMM301EACBL.53.22.B11.1.454.light.4.raw
cgcgtatacacacgaccggtgctcgatttagacgacagctcagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccaattggtacttatgtcttcggaactgcgaccaaggtcaccgtcctgggtcagcccaaaggccaaccccaacctgtcactctcg

SEQ ID NO: 600175 - DNA, 444 bp, Homo sapiens; identical to SEQ ID NO: 535027
  misc_feature: HIJSMM301EIYNE.8.73.G07.1.454.light.4.raw

SEQ ID NO: 600176 - DNA, 490 bp, Homo sapiens; identical to SEQ ID NO: 570189
  misc_feature: HIJSMM301DYF5D.8.4.A04.1.454.light.4.raw

SEQ ID NO: 600177 - DNA, 475 bp, Homo sapiens
  misc_feature: HIJSMM301BKM2O.5.36.D03.1.454.light.4.raw
atcagacacgcacgaccggtgctcgatttagctgcgtcacgatctctcttgggggagtcagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggcaacttattactgccaacagtatgatagttattggacttcggccaagggaccaagatagaaaatcaaaacgaactagtgg

SEQ ID NO: 600178 - DNA, 503 bp, Homo sapiens; identical to SEQ ID NO: 535044
  misc_feature: HIJSMM301EJE66.19.78.H01.1.454.light.4.raw

SEQ ID NO: 600179 - DNA, 483 bp, Homo sapiens
  misc_feature: HIJSMM301AC8WQ.16.81.H04.1.454.light.4.raw
  modified_base (443)..(443): a, c, t, g, unknown or other
tgtactactccacgaccggtgctcgatttagtagtgtagattcgcgggggaggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaacttcgtcgtcgacganagtagtgtatacaacgaacaagtaggtcgtcgcgtaccac

SEQ ID NO: 600180 - DNA, 509 bp, Homo sapiens; identical to SEQ ID NO: 539359
  misc_feature: HIJSMM301E3L8C.47.85.H08.1.454.light.4.raw

SEQ ID NO: 600181 - DNA, 485 bp, Homo sapiens
  misc_feature: HIJSMM301CM5BI.12.8.A08.1.454.light.4.raw
atacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccagcatcacctgctctggagatgtattgactaatgagtatgcttcctggtatcagcagaaggcaggccagccccctgtcctactcagtctttcaaaataccaggcggccctctggggtccctgagcgattctctggctccgactctgggaacacagtcactctgaccatcagcgggacccaggctattgatgaggctgtctactactgtcaggcgtgggacagcagcgtggtgttcggcggagggaccagtctgaccgtcttaggtcagcccaaggctgccccctcggtcta

SEQ ID NO: 600182 - DNA, 507 bp, Homo sapiens
  misc_feature: HIJSMM301DH59L.11.57.F02.1.454.light.4.raw
  modified_base (470)..(470): a, c, t, g, unknown or other
cgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctcggcacgtgccaaggacgagtggaagtcaagcgatacgnggctgcaccatctgtcttctatcttcccgtcccatcc

SEQ ID NO: 600183 - DNA, 496 bp, Homo sapiens
  misc_feature: HIJSMM301B0LYD.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcgacggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcaccatctgtctt

SEQ ID NO: 600184 - DNA, 502 bp, Homo sapiens; identical to SEQ ID NO: 574478
  misc_feature: HIJSMM301DUXKV.19.78.H01.1.454.light.4.raw

SEQ ID NO: 600185 - DNA, 499 bp, Homo sapiens
  misc_feature: HIJSMM301D0IUT.51.83.H06.1.454.light.4.raw
cgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagtttattattgtcagcagcgaaacaactggcctccttggacgttcggccaagggaccaaggtaggaaatacaaacgaaactgtggctgcaccatctgtcttcatt

SEQ ID NO: 600186 - DNA, 484 bp, Homo sapiens
  misc_feature: HIJSMM301D04M8.48.73.G07.1.454.light.4.raw
agtatacatacacgaccggtgctcgatttagctctacgctcagggggcaggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggccaagggaccgagggtggaagtacaaacgaactagtggctgcaccat

SEQ ID NO: 600187 - DNA, 480 bp, Homo sapiens; identical to SEQ ID NO: 554620
  misc_feature: HIJSMM301AS4R6.4.29.C07.1.454.light.4.raw

SEQ ID NO: 600188 - DNA, 484 bp, Homo sapiens; identical to SEQ ID NO: 536162
  misc_feature: HIJSMM301DLJQB.13.59.F04.1.454.light.4.raw

SEQ ID NO: 600189 - DNA, 496 bp, Homo sapiens; identical to SEQ ID NO: 537925
  misc_feature: HIJSMM301EUUZI.22.14.B03.1.454.light.4.raw

SEQ ID NO: 600190 - DNA, 404 bp, Homo sapiens
  misc_feature: HIJSMM301ADDKE.11.67.G01.1.454.light.4.raw
cgagagataccacgaccggtgctcgatttagagtatacatattgggtttggggacccccgggcagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctggcacctcagcctccctggcctgcagtgggctccagtctgaggatgaggctgactattattgtgcagcgtgggatgacggtctgagtgctgtggtcttcggcggagggaccaagctgaccgtcctgggtcagcccaaggctgccccctcggtcactctgttcccaccctcctcgtatctctcg

SEQ ID NO: 600191 - DNA, 506 bp, Homo sapiens
  misc_feature: HIJSMM301A0JGN.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggccctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatcttcccgcc

SEQ ID NO: 600192 - DNA, 522 bp, Homo sapiens
  misc_feature: HIJSMM301BDDGY.13.4.A04.1.454.light.4.raw
tcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaacgcgggacccagaccctggagcctcagttggaagcagccgatccagcctgcggagccgtgtggggcgaggtcagcccaacggcccaacccccactcgtcactctcgttcccccg

SEQ ID NO: 600193 - DNA, 482 bp, Homo sapiens
  misc_feature: HIJSMM301DM829.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagctagcaactggcctctcactttcggcggagggaccagggtggagatcagacgaa

SEQ ID NO: 600194 - DNA, 494 bp, Homo sapiens; identical to SEQ ID NO: 549057
  misc_feature: HIJSMM301EJKUU.10.33.C11.1.454.light.4.raw

SEQ ID NO: 600195 - DNA, 511 bp, Homo sapiens
  misc_feature: HIJSMM301A3YLQ.16.66.F11.1.454.light.4.raw
tgtactactccacgaccggtgctcgatttagtcacgcgagaagggtgagaagtagtggagcatcccactatggcctgggctccactacttctcaccctcctcgctcactgcacaggttcttgggccaatttctactgactcagcccactctgtgtcggagtctccgggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcacccatctctggactgaagactgaggacgaggctgactactactgtcagtcttatgataacaccagggtggtgttcggcggagggaccaagctggccgtcctaggtcagcccaaggctgccccctcggtcactctgttcccaccctcctcgagtagtaca

SEQ ID NO: 600196 - DNA, 513 bp, Homo sapiens
  misc_feature: HIJSMM301DCD60.40.12.B01.1.454.light.4.raw
tctagcgactcacgaccggtgctcgatttagtagtgtagattccgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggcaacaattgggtcttcggcggagggaccaagctgaccgtcctaggtcagcccaaggctgccccctcggtcactctgttccc

SEQ ID NO: 600197 - DNA, 515 bp, Homo sapiens; identical to SEQ ID NO: 547905
  misc_feature: HIJSMM301AUL96.8.23.C01.1.454.light.4.raw

SEQ ID NO: 600198 - DNA, 488 bp, Homo sapiens; identical to SEQ ID NO: 535081
  misc_feature: HIJSMM301C8WA0.26.23.C01.1.454.light.4.raw

SEQ ID NO: 600199 - DNA, 503 bp, Homo sapiens; identical to SEQ ID NO: 544567
  misc_feature: HIJSMM301C9THY.41.35.D02.1.454.light.4.raw

SEQ ID NO: 600200 - DNA, 513 bp, Homo sapiens
  misc_feature: HIJSMM301B8B3Z.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagccggtgatgaggctgactatttttgtcaggtgtgggacagcagcatttatgtcttcggacctgggaccaaggtcaccgtcctaggtcagcccaaggccaaccccactgtcactctgttcccgcctcctcga

SEQ ID NO: 600201 - DNA, 478 bp, Homo sapiens
  misc_feature: HIJSMM301B9GV9.26.72.G06.1.454.light.4.raw
agactatactcacgaccggtgctcgatttagctacgactgcaagggaaagggtgagatccctcactgtggctcactttcagcggagggaccacggtggagatcacacgtaagtgcactttcctaatgctttttcttataaggttttaagtttggagcgtttttgtgtttgagatgttagctcaggtcaattccaaagagtaccagattctttcaaaaagtcagatgagtaagggatagaaaattagttcaccttaaggaacagccgagcgctagccagttaagtgaggcatctcaattgcaaggttttctctgcatcggtcaggttagtgatattaacagcgaaaagagatttttgttaaggggaaagtaatgaagttaacactgtggatcaccttcggccaagggacacgactggagattaaacgaactgtggctgcaccatctgtcttcatcttcccgccatctgaagtatagtct

SEQ ID NO: 600202 - DNA, 486 bp, Homo sapiens; identical to SEQ ID NO: 535290
  misc_feature: HIJSMM301B37PL.3.12.B01.1.454.light.4.raw

SEQ ID NO: 600203 - DNA, 470 bp, Homo sapiens
  misc_feature: HIJSMM301CPU8D.49.75.G09.1.454.light.4.raw
agtcgagagacacgaccggtgctcgatttagtatagacatcaggggcagtcccaaccaggacacagcatggacatgagggtccctgctcagctcctggggctcctgctgctctggctctcaagtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcacgtttcggcgggggaccgaaggtggagatccagcgaactgtggctgca

SEQ ID NO: 600204 - DNA, 518 bp, Homo sapiens; identical to SEQ ID NO: 539372
  misc_feature: HIJSMM301CI202.7.86.H09.1.454.light.4.raw

SEQ ID NO: 600205 - DNA, 501 bp, Homo sapiens; identical to SEQ ID NO: 555551
  misc_feature: HIJSMM301EFING.21.81.H04.1.454.light.4.raw

SEQ ID NO: 600206 - DNA, 486 bp, Homo sapiens; identical to SEQ ID NO: 535043
  misc_feature: HIJSMM301C7O6E.46.35.D02.1.454.light.4.raw

SEQ ID NO: 600207 - DNA, 517 bp, Homo sapiens
  misc_feature: HIJSMM301A8ZBW.48.17.B06.1.454.light.4.raw
agtatacatacacgaccggtgctcgatttagtcgatagtgaaggggggggtcacaagaggcagcgctctcgggacgtctccaccatggcctgggctctgctgctcctcaccctcctcactcaggacacagggtcctgggcccaggctgccctgactcagccagcctccgtgtctgcctctcctggacagtcggtcaatctttcctgcactggaaccgcctatgacattggaaaatataaccttgtctcctggtaccagcaacacccaggcaaagcccccaaattaattatttatacggtcaataagagaccgtcaggggtctctgctcgcttctctgggtccaagtctggcgacacggcctccctcacaatctctgggctccaggctgacgacgaggcttcctattgctgctcctcatatgtaggatccggctcttatctgattttcggcggagggaccaagctgaccgtcctacgtcagcccaaggctgccccctcggtcactctgttcccgccct

SEQ ID NO: 600208 - DNA, 472 bp, Homo sapiens
  misc_feature: HIJSMM301BTB1Q.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcacttcgccctggctgaagtgcatatgaagagaactgtggctgca

SEQ ID NO: 600209 - DNA, 479 bp, Homo sapiens; identical to SEQ ID NO: 535188
  misc_feature: HIJSMM301BD5PY.10.74.G08.1.454.light.4.raw

SEQ ID NO: 600210 - DNA, 497 bp, Homo sapiens
  misc_feature: HIJSMM301C04WK.52.34.D01.1.454.light.4.raw
cgcagtacgacacgaccggtgctcgatttagatcgtctgtgttgggtttgggcacgaccggtgctcgatttagatcgtctgtgttgggtttgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcgtgggtctgggacagacttcactctcaccatcagcagcctagagcctgaagattttgcagttattactgtcagcagcgtagcaactggcctccgatcaccttcggccaaggacacga

SEQ ID NO: 600211 - DNA, 509 bp, Homo sapiens; identical to SEQ ID NO: 557518
  misc_feature: HIJSMM301EBCSS.8.34.D01.1.454.light.4.raw

SEQ ID NO: 600212 - DNA, 512 bp, Homo sapiens
  misc_feature: HIJSMM301DRYF6.48.34.D01.1.454.light.4.raw
  modified_base (508)..(508): a, c, t, g, unknown or other
agtatacatacacgaccggtgctcgatttagatcgtctgtgttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgttcccnccct

SEQ ID NO: 600213 - DNA, 359 bp, Homo sapiens
  misc_feature: HIJSMM301DLHDE.5.56.F01.1.454.light.4.raw
atcagacacgcacgaccggtgctcgatttagcagacgtctgaacacacaaagggcctgcatagtaatggatacaactatttggattggtacctgcagaagccagggcagtctccacagctcctgatctatttgggttctaatcgggcctccggggtccctgacaggttcagtggcagtggatcaggcacagatttttacactgaaaatcagcagagtggaggctgaggatgttggggtttattactgcatgcaagctctacaaactccgctcactttcggcggagggaccaaggtgcagatcaaacgaactgtggctgcaccatctgtcttcatcttcccgccatctgacgtgtctgat

SEQ ID NO: 600214 - DNA, 493 bp, Homo sapiens; identical to SEQ ID NO: 535745
  misc_feature: HIJSMM301EMEKN.47.78.H01.1.454.light.4.raw

SEQ ID NO: 600215 - DNA, 488 bp, Homo sapiens; identical to SEQ ID NO: 574551
  misc_feature: HIJSMM301BHNCO.47.36.D03.1.454.light.4.raw

SEQ ID NO: 600216 - DNA, 513 bp, Homo sapiens
  misc_feature: HIJSMM301AIC9X.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcggggcgttcggccgaagggaccgaaggtaggaaagtacaaacgaactagtggctgcaccatctcgtcttctatctttccccg

SEQ ID NO: 600217 - DNA, 486 bp, Homo sapiens; identical to SEQ ID NO: 535385
  misc_feature: HIJSMM301DCT88.19.71.G05.1.454.light.4.raw

SEQ ID NO: 600218 - DNA, 489 bp, Homo sapiens
  misc_feature: HIJSMM301B4DIL.48.75.G09.1.454.light.4.raw
agtatacatacacgaccggtgctcgatttagtatagacatcagggggatcaggacttctcagttcatcttctcaccatgaggctccctgctcagctcctggggctgctaatgctctggatccctggatccactgcgggtgttgtgttgacccaggctcccctgtctctgtccgtcacccctggacagccggccgccatgtcgtgcaattctagtcggagcctcttctatgaggacggcaggacctacttctattggtacatgcagaagccgggccggtctccacagctcctgatgtctgagatttccaggcgattccctggagtgccagagaggttcagtggcagcggagcagggacagagttcacactgaaaatcagccgggtggaggctgaggatgttggcctttattactgcatgcaaggtatcttcctcccatacacttttggcccggggaccaaggtggatctcaaaagaactgtggctgcacc

SEQ ID NO: 600219 - DNA, 504 bp, Homo sapiens
  misc_feature: HIJSMM301CVCRU.40.41.D08.1.454.light.4.raw
tctagcgactcacgaccggtgctcgatttagtcacgcgagaaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggcctcaggggtttctaatcgcttctctggctccaagtctggcaacacggcctccctgaccatctctgggctccaggctgaggacgaggctgattattactgcagctcatatacaagcagcagcactccccatgtggtattcggcggagggaccaagctgaccgtctaggtcagcccaaggctgccccccg

SEQ ID NO: 600220 - DNA, 489 bp, Homo sapiens; identical to SEQ ID NO: 540655
  misc_feature: HIJSMM301DUZ3R.22.87.H10.1.454.light.4.raw

SEQ ID NO: 600221 - DNA, 506 bp, Homo sapiens; identical to SEQ ID NO: 554661
  misc_feature: HIJSMM301ESKED.3.79.H02.1.454.light.4.raw

SEQ ID NO: 600222 - DNA, 486 bp, Homo sapiens
  misc_feature: HIJSMM301D36NR.14.53.E09.1.454.light.4.raw
cgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgcttttttggaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggagggaccaagctgaccgtcctaggtcagcccaaggctgccccctcggtctac

SEQ ID NO: 600223 - DNA, 486 bp, Homo sapiens
  misc_feature: HIJSMM301DIAT8.4.4.A04.1.454.light.4.raw
agcactgtagcacgaccggtgctcgatttagagtagtgatcaggggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgtcgggcaagtcagagtattaatagttggttggcctggtatcaccagagaccaggagaggccccaaggctccttatttatgatgcctccactgtgattagtggggtcccaccaacgttcagcggcagtggatctgggacatacttcactctcaccatcagcagcctgcagcctgatgatcttggaacttattactgccaacagtataatagtttttggacgttcggccaggggacgaaggtcgaaatagagacgaactgtggctgcaccatctgtcttcta

SEQ ID NO: 600224 - DNA, 496 bp, Homo sapiens; identical to SEQ ID NO: 537925
  misc_feature: HIJSMM301ELLR5.22.14.B03.1.454.light.4.raw

SEQ ID NO: 600225 - DNA, 494 bp, Homo sapiens; identical to SEQ ID NO: 535629
  misc_feature: HIJSMM301CZQ34.4.27.C05.1.454.light.4.raw

SEQ ID NO: 600226 - DNA, 506 bp, Homo sapiens; identical to SEQ ID NO: 534969
  misc_feature: HIJSMM301B2QP9.18.37.D04.1.454.light.4.raw

SEQ ID NO: 600227 - DNA, 503 bp, Homo sapiens; identical to SEQ ID NO: 543062
  misc_feature: HIJSMM301AT6H1.16.49.E05.1.454.light.4.raw

SEQ ID NO: 600228 - DNA, 377 bp, Homo sapiens; identical to SEQ ID NO: 536071
  misc_feature: HIJSMM301C7YTB.40.9.A09.1.454.light.4.raw

SEQ ID NO: 600229 - DNA, 498 bp, Homo sapiens
  misc_feature: HIJSMM301CNK47.14.36.D03.1.454.light.4.raw
cgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaactcatgatttatgaggtcagtaatcggccctcagggtttctaatcgcttctctggctccaagtctggcaacacggcctccctgaccatctctgggctccaggctgaggacgagtctgattattattgcagctcatatgcacctggcagcaatcatgtggttttcggcggggggaccaagggtgaccggtcctaggtcagcccaaggcc

SEQ ID NO: 600230 - DNA, 506 bp, Homo sapiens
  misc_feature: HIJSMM301A1P0J.49.65.F10.1.454.light.4.raw
agtcgagagacacgaccggtgctcgatttagctacgctctaaggggctggcctaaggaagcagcactggtggtgcctcagccatggcctggaccgttctcctcctcggcctcctctctcactgcacagtctctgtgacctcctatgtgctgtctcagtcaccctcggtgtcagtggccccaggacagacggccaggattacctgtgggggagacaacattggaaataaaggtgtgcactggtaccagcagatgccaggccaggcccctgtcctggtcgtctttgatgatagcgaccggccctcagggatccctgagcgattctctggctccaactctggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccaccct

SEQ ID NO: 600231 - DNA, 509 bp, Homo sapiens
  misc_feature: HIJSMM301BYSQE.48.78.H01.1.454.light.4.raw
agtatacatacacgaccggtgctcgatttagtgtgagtagtttgggtttgggggctgtcaaactgattaggaactgacttccacctgcaggtcagggccaaggttatggggtcccaggttcacctcctcagcttcctcctcctttggatctctgataccagggcagaaacgacactcacgcagtctccagcattcatgtcagcgactccaggagacaaagtcaacatctcctgcaaaggcagccaagactttgatggtgatatgaactggtaccaacacagaccaggagaagctgctattttcattattcaagaggctactactctcgttcctggaatcgcacctcgattccgtggcagcggatttggaacagattttaccctcacaattaaaaacatagaatgtgaggatgctgcatattacttctgtctgcaatatgataacgtccccctacgtggacgttcggccaagggaccaaggtggaaatacaaacgaactgtggctgcacc

SEQ ID NO: 600232 - DNA, 485 bp, Homo sapiens; identical to SEQ ID NO: 559908
  misc_feature: HIJSMM301B4U2Z.3.88.H11.1.454.light.4.raw

SEQ ID NO: 600233 - DNA, 506 bp, Homo sapiens; identical to SEQ ID NO: 536038
  misc_feature: HIJSMM301C3FZR.7.71.G05.1.454.light.4.raw

SEQ ID NO: 600234 - DNA, 494 bp, Homo sapiens; identical to SEQ ID NO: 535629
  misc_feature: HIJSMM301DZL68.4.27.C05.1.454.light.4.raw

SEQ ID NO: 600235 - DNA, 446 bp, Homo sapiens
  misc_feature: HIJSMM301BD190.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctggccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaaccctctgtcactctgttcccgccctcctccatactcgta

SEQ ID NO: 600236 - DNA, 482 bp, Homo sapiens
  misc_feature: HIJSMM301B4VQ3.52.22.B11.1.454.light.4.raw
cgcagtacgacacgaccggtgctcgatttagacgacagctcaggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcatttgccgggcaagtcagagtattagcagctatttaaattggtatcaacataccccggggaaggcccctaagttactgatctatgctgcagccaatttgcaaagtggggtcccatcaaggttcagtggcagtggatctgggacagaattcactctcaccatcagcagtctgcaacctgaagattttggaaagtctattgtacaacagagttacggaaacttgctcattttcggcggagggccaaggtggagatcaaacgaactgtggctgcaccatctgt

SEQ ID NO: 600237 - DNA, 480 bp, Homo sapiens
  misc_feature: HIJSMM301B9W2H.11.11.A11.1.454.light.4.raw
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaacctgcaggctgaagatgtggcagtttattactgtcagcagtattgtgaagctccgctcactttcggcggagggaccggcggtggaggatcagacgaactgtggctgcaccatctgtctt

SEQ ID NO: 600238 - DNA, 499 bp, Homo sapiens
  misc_feature: HIJSMM301CW8FR.52.65.F10.1.454.light.4.raw
cgcagtacgacacgaccggtgctcgatttagctacgctctaagggggcaggagtcagacccagtcaggacacagcatggacatgagggtccccgctcagctcctggggctcctgctgctctggttcccaggtgccaggtgcgacatccagatgacccagtctccatcttccgtgtctgcatctgtaggagacagagtcaccatcacttgtcgggcgagtcaggttgttagcgcctggttagcctggtatcagcagaaaccagggaaagcccctaaagtcctggtctatgctacatccaatttgcaaagtggcgtccctcaaggttccgcggcagtggatctgggacaaatttcactctcaccatcagcagcctgcagcctgaagattttgcgacttactattgtcaacaggggtacagttttccgtacaccttttggccaggggactaagctggacatcaaacgaactgtggctgcaccatctgtcttcatcttccccg

SEQ ID NO: 600239 - DNA, 486 bp, Homo sapiens; identical to SEQ ID NO: 535043
  misc_feature: HIJSMM301AEKC4.46.35.D02.1.454.light.4.raw

SEQ ID NO: 600240 - DNA, 496 bp, Homo sapiens
  misc_feature: HIJSMM301AV1JD.15.31.C09.1.454.light.4.raw
tctacgtagccacgaccggtgctcgatttagacgtctcatcaaggaaggaaggggggggtctcaggaggcagcgctctcagaacatctccaccatggcctgggctctgctgctcctcaccctcctcactcagggcacagggtcctgggcccagtctgccctgactcagcctgcctccgtgtctgggtctcttggacagtcgatcaccatctcctgcactggaaccagcagtgacgttggtacttataactatgtctcctggtaccaacagaacccaggcaaagcccccaaactcatgatttatgaggtcagtaatcggccctcaggggtttctaatcgcttctctggctccaagtctggcaacatggcctccctgaccatctctgggctccaggctgaggacgaggctgattattactgcagctcatatacaagcagcagcactccttgggtgttcggcggagggaccaagctgaccgtcctaggtcagcccaagg

SEQ ID NO: 600241 - DNA, 450 bp, Homo sapiens
  misc_feature: HIJSMM301CNBDE.18.9.A09.1.454.light.4.raw
tacgagtatgcacgaccggtgctcgatttagcgagacgcgcagggtcctgggcccaatctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaaccccctctcgtcactctcgttcccaccctcctccatactcgta

SEQ ID NO: 600242 - DNA, 495 bp, Homo sapiens
  misc_feature: HIJSMM301ELV20.51.29.C07.1.454.light.4.raw
cgatcgtatacacgaccggtgctcgatttagagtgctacgaagggaaagggggaggaactgctcagtcaggacccagacggaaccatggaagccccagcgcagcttctcttcctcctgctactctggctcccagatactactggagaaatagtgatgacgcagtctccagccacgctgtctgtgtctccaggggaaagagccaccctctcctgcagggccagtcagagtgttaacaacaacttagcctggtatcagcagaaacctggccaggctcccaggctcctcatctttggatcatccatcagggccactggtgtcccagaaaagttcagtggcggtgggtctgacacagagtacaccctcaccatcagcaccctgcagtctgaagatgtcgcagtttattactgtcaacaatatagtgacaggccgccatggacttcggccaagggaccaaggtggaaatagaaaggaactgtggctgcaccatctgtctt

SEQ ID NO: 600243 - DNA, 486 bp, Homo sapiens
  misc_feature: HIJSMM301CX6NX.52.83.H06.1.454.light.4.raw
cgcagtacgacacgaccggtgctcgatttagatcacgtgcgtcgcgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaattatttaaattggtatcagcagaaaccagggaaagcccctaaactcctgatctacgatgcatccaatttggaaacaggggtcccatcaaggttcagtggaagtggttctgggacacattttactttcaccatcagcggcctgcagcctgaagatattgcaacatattactgtcaacagtatggtaatctcccactcactttcggcggagggaccaaggtcgagatcaacgaactgtggctgcaccatctgtctt

SEQ ID NO: 600244 - DNA, 498 bp, Homo sapiens; identical to SEQ ID NO: 539425
  misc_feature: HIJSMM301B5FHT.43.42.D09.1.454.light.4.raw

SEQ ID NO: 600245 - DNA, 493 bp, Homo sapiens; identical to SEQ ID NO: 535745
  misc_feature: HIJSMM301BGFEF.47.78.H01.1.454.light.4.raw

SEQ ID NO: 600246 - DNA, 517 bp, Homo sapiens
  misc_feature: HIJSMM301EQVLN.14.66.F11.1.454.light.4.raw
cgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctcggaagctattatgcaagctggtaccagcagaagccaggacaggcccctgtacttgtcatctatggtaaaacatccggccctcagggatcccagaccgattctctggctccaactcaggaaacacagcttccttgaccatcactggggctcaggcggaagatgaggctgactattactgtaattcccgggacagcagtgctaaccccaattatgtcttcggaactgggaccaaggtcaccgtcctaggtcagcccaaggccaaccccac

SEQ ID NO: 600247 - DNA, 495 bp, Homo sapiens; identical to SEQ ID NO: 574490
  misc_feature: HIJSMM301E09AB.16.53.E09.1.454.light.4.raw

SEQ ID NO: 600248 - DNA, 502 bp, Homo sapiens
  misc_feature: HIJSMM301D5HXE.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgacccatcactggggctcaggcggaagatgaggctgactattactgtaacctcccgggccagcagtggtaacattgtgatattcggcggagggaccaaggtgaccgtcctacgtcagcccaaggctcgccccctcggtcactcttccg

SEQ ID NO: 600249 - DNA, 550 bp, Homo sapiens
  misc_feature: HIJSMM301D8295.7.31.C09.1.454.light.4.raw
cgtgtctctacacgaccggtgctcgatttagacgtctcatcaaggaaggaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataagtatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaagatgaggctgattattactgctgctcattatgcgacggccgcaaacgagtgtattacttagttccggggacggggaacgggaacccaaagtcgtacggtaacccgttccgttacggtcgaaccgacccgaaggtcctcccgcccccgttcc

SEQ ID NO: 600250 - DNA, 500 bp, Homo sapiens
  misc_feature: HIJSMM301CY5BV.43.37.D04.1.454.light.4.raw
tgtgagtagtcacgaccggtgctcgatttagtagcatactgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaaccctac

SEQ ID NO: 600251 - DNA, 511 bp, Homo sapiens; identical to SEQ ID NO: 542853
  misc_feature: HIJSMM301CZ42T.17.33.C11.1.454.light.4.raw

SEQ ID NO: 600252 - DNA, 495 bp, Homo sapiens; identical to SEQ ID NO: 547042
  misc_feature: HIJSMM301A02A8.51.59.F04.1.454.light.4.raw

SEQ ID NO: 600253 - DNA, 510 bp, Homo sapiens; identical to SEQ ID NO: 535474
  misc_feature: HIJSMM301BW65A.17.33.C11.1.454.light.4.raw

SEQ ID NO: 600254 - DNA, 515 bp, Homo sapiens; identical to SEQ ID NO: 538805
  misc_feature: HIJSMM301AOFVL.14.19.B08.1.454.light.4.raw

SEQ ID NO: 600255 - DNA, 485 bp, Homo sapiens
  misc_feature: HIJSMM301C7WNG.14.53.E09.1.454.light.4.raw
cgtctagtaccacgaccggtgctcgatttagagagagtgtgttgggtttgggggggagcctagctgtgctgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggaggaccaagctgaccgtccta

SEQ ID NO: 600256 - DNA, 489 bp, Homo sapiens
  misc_feature: HIJSMM301ALWPG.40.37.D04.1.454.light.4.raw
tctagcgactcacgaccggtgctcgatttagtagcatactgttgggtttggggaggacttctcagttcatcttctcaccatgaggctccctgctcagctcctggggctgctaatgctctggatccctggttccagtgcgagggttgtgatgactcagactccactctctctgtccgtcacccctggacagccggcctccatctcctgcaagtctgctcagagcctcctgcatggtgatggaatcacctatttatattggtacctgcagaagccaggccagtctccacagctcctaatctatgaggtttccagccggttctctggagtgccagataggttcagtggcagcgggtcagtgacagatttcacactgaaaatcagccgggtggaggctgaggatgttggggtttattactgcatgcaaggtttataccttcctcggactttcggcccgtcgggaccgacgagtggatgtcaacgaactagtgg

SEQ ID NO: 600257 - DNA, 460 bp, Homo sapiens; identical to SEQ ID NO: 536053
  misc_feature: HIJSMM301C29V0.22.28.C06.1.454.light.4.raw

SEQ ID NO: 600258 - DNA, 456 bp, Homo sapiens
  misc_feature: HIJSMM301CI9KS.40.76.G10.1.454.light.4.raw
tctagcgactcacgaccggtgctcgatttagtcactcatacagggggcagaagtctctctcagtcaggacacagcatggacatgagggtccctgctcagctcctgggactcctgctgctctggctcccagataccagatgtgacatccagatgacccagtctccatcttccctgtctgcgtctgtaggagacagagtcaccatcacttgccgggcgagtcaggacattggcatttatgtagcctggtataaggagacaccaggaaaagttcctcaactcctgatctatggtgcatccactctgcacttcggggtcccatctcggttcagcggcagcggatctgggacacatttcactctcaccatcagcagcctgcagcctgaagatgttgcagtttattactgtcaaaagtatgacactgtcccgctcactttcggcggaggaccaaggtggaga

SEQ ID NO: 600259 - DNA, 486 bp, Homo sapiens
  misc_feature: HIJSMM301ENS21.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctcggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaaccttcggccaggggacacgactggagattaaacgaactgtggctgcaccatctgt

SEQ ID NO: 600260 - DNA, 475 bp, Homo sapiens
  misc_feature: HIJSMM301DBC3O.5.70.G04.1.454.light.4.raw
atcagacacgcacgaccggtgctcgatttagtgtagtgtgaagggaaagggggcaggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctgaagattttgcaacttacttttgtcaacaggctcagagttttcccgctcactttcggcggagggaccaaaggtggagatcaaacgaaa

SEQ ID NO: 600261 - DNA, 495 bp, Homo sapiens; identical to SEQ ID NO: 538522
  misc_feature: HIJSMM301A3OOC.10.79.H02.1.454.light.4.raw

SEQ ID NO: 600262 - DNA, 487 bp, Homo sapiens
  misc_feature: HIJSMM301BA843.17.39.D06.1.454.light.4.raw
cgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaaacctggccaggctcccaggctcctcatgtatggtgcatctaccagggccactggtgtcccagccaggttcagtggcagtgggtctgggacagagttctctctcatcatcagcagcctgcagtctgaagattttgcggtttattactgtcagcagtataatcagtggcctccgtggacgttcggccaagggaccaaggtaggaatacaaacgaactgtggctgca

SEQ ID NO: 600263 - DNA, 491 bp, Homo sapiens; identical to SEQ ID NO: 542310
  misc_feature: HIJSMM301CU8X0.22.65.F10.1.454.light.4.raw

SEQ ID NO: 600264 - DNA, 377 bp, Homo sapiens; identical to SEQ ID NO: 536071
  misc_feature: HIJSMM301AZ2AE.40.9.A09.1.454.light.4.raw

SEQ ID NO: 600265 - DNA, 479 bp, Homo sapiens; identical to SEQ ID NO: 535118
  misc_feature: HIJSMM301EZ2YI.13.59.F04.1.454.light.4.raw

SEQ ID NO: 600266 - DNA, 520 bp, Homo sapiens; identical to SEQ ID NO: 539176
  misc_feature: HIJSMM301CYVR0.27.23.C01.1.454.light.4.raw

SEQ ID NO: 600267 - DNA, 447 bp, Homo sapiens; identical to SEQ ID NO: 535020
  misc_feature: HIJSMM301AZKUL.18.9.A09.1.454.light.4.raw

SEQ ID NO: 600268 - DNA, 480 bp, Homo sapiens
  misc_feature: HIJSMM301B5NCI.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggccctgggactgaagtgcatatgaagagaactgtggctacaccta

SEQ ID NO: 600269 - DNA, 467 bp, Homo sapiens
  misc_feature: HIJSMM301COVAV.51.67.G01.1.454.light.4.raw
cgatcgtatacacgaccggtgctcgatttagagtatacatattgggtttgggggtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggcggggggaccaaggtggagatcaagcgaa

SEQ ID NO: 600270 - DNA, 498 bp, Homo sapiens; identical to SEQ ID NO: 569811
  misc_feature: HIJSMM301AF0ED.18.11.A11.1.454.light.4.raw

SEQ ID NO: 600271 - DNA, 497 bp, Homo sapiens
  misc_feature: HIJSMM301EZXSI.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtctaggtcagcccaaggccaa

SEQ ID NO: 600272 - DNA, 485 bp, Homo sapiens
  misc_feature: HIJSMM301CIQ1T.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcagttctacaaacttcctacacttttggccagggaccaagctggagatcaaacgaa

SEQ ID NO: 600273 - DNA, 503 bp, Homo sapiens
  misc_feature: HIJSMM301BTQMS.7.31.C09.1.454.light.4.raw
  modified_base (364)..(364): a, c, t, g, unknown or other
cgtgtctctacacgaccggtgctcgatttagacgtctcatcaaggaaggaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataagtatgtctcctggtaccaacaacacccaggcaaagcccccaaactcatgatttatgaggtcactaagcggccctcaggggtccctgatcgcttctctggctccaagtctggcaacncggcctccctgaccgtctctgggctccaggctgaagatgaggctgattattactgctgctcatatgcaggccgcaacagtgatctattcggcggagggaccaagctgaccgtcctaggtcagcccaaggctgccccctc

SEQ ID NO: 600274 - DNA, 488 bp, Homo sapiens; identical to SEQ ID NO: 551155
  misc_feature: HIJSMM301ALTPL.3.33.C11.1.454.light.4.raw

SEQ ID NO: 600275 - DNA, 454 bp, Homo sapiens; identical to SEQ ID NO: 534964
  misc_feature: HIJSMM301D9BW8.19.86.H09.1.454.light.4.raw

SEQ ID NO: 600276 - DNA, 515 bp, Homo sapiens
  misc_feature: HIJSMM301C7IBT.52.16.B05.1.454.light.4.raw
cgcagtacgacacgaccggtgctcgatttagagctcacgtaaggggctgggcctaaggaagcagcactggtggtgcctcagccatggcctggaccgttctcctcctcggcctcctctctcactacacagactatgtgacttcctatgtgctgactcagccaccctcggcgtcagtggccccaggacagacggccacgattacctgtgagggaaactacattgaaaggaaaagtgtccattggtatcagcagaagccaggccaggcccctgtgctggtcctccatgatgatagcgaccggccctcagggatccctgagggattctccggctccaactctgggaacacggccaccctgaccatcagcagggtcgaagccggagatgaggccgactattactgtcaggtgtgggatcgtgatagtgaccattgggtgttcggcggagggaccaagttgaccgtctaagtcagccaaggctgccccctcggtcactctgttcccgccctcctctatacg

SEQ ID NO: 600277 - DNA, 482 bp, Homo sapiens
  misc_feature: HIJSMM301BXE39.5.41.D08.1.454.light.4.raw
atcagacacgcacgaccggtgctcgatttagtcacgcgagaaagggaaaggggctgatcaggactcctcagttcaccttctcacaatgaggctccctgctcagctcctggggctgctaatgctctgggtctctggatccagtggggagattgtgctgactcagtctccactctccctgtccgtcacccctggagagccggcctccatctcctgcaggtctagtcagagcctcctgcatagtaatggattcaactatttggattggtacctgcagaggccagggcagtctccacagctcctggtctatttgggctcttatcgggcctccggggtccctgagaggttcagtggcagtggatcaggcacagactttacactgcgaatcagcagagtggaggctgaggatgttggggtttattactgcatgcaagctctacaacctattcactttcggccctggaccagagtggatatcaaacgaa

SEQ ID NO: 600278 - DNA, 513 bp, Homo sapiens
  misc_feature: HIJSMM301DEGE0.43.71.G05.1.454.light.4.raw
tgtgagtagtcacgaccggtgctcgatttagtgtcgtcgcaagagagaggggcacgaccggtgctcgatttagtgtcgtcgcaagagagaggggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagatttgcagtgtattactgtcaccagtatggtagctcacctaagacgttcggccaagggaccaaggtggaaatcaaacg

SEQ ID NO: 600279 - DNA, 501 bp, Homo sapiens; identical to SEQ ID NO: 550407
  misc_feature: HIJSMM301DBF73.4.39.D06.1.454.light.4.raw

SEQ ID NO: 600280 - DNA, 490 bp, Homo sapiens; identical to SEQ ID NO: 543909
  misc_feature: HIJSMM301ADY6N.14.55.E11.1.454.light.4.raw

SEQ ID NO: 600281 - DNA, 496 bp, Homo sapiens
  misc_feature: HIJSMM301D2BV0.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtctaggtcagcccaaggctg

SEQ ID NO: 600282 - DNA, 498 bp, Homo sapiens
  misc_feature: HIJSMM301ENENL.2.49.E05.1.454.light.4.raw
acgctcgacacacgaccggtgctcgatttagagcgactagcaacacacaaaggggggggaagctcagcttcagctgtggtagagaagacaggattcaggacaatctccagcatggccggcttccctctcctcctcacccacctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagagcggcccccaagctcctcatctatagaaattatgaacggtcctcaggggtccctgaccgattctctggctccaagtctggcacctcagcctccctggccatccagtgggctccggtccgaggatgaggctgattattactgtgttggatgggacagcagcctgagtgcttatgtcttcggaactgggaccacggtcaccgtcct

SEQ ID NO: 600283 - DNA, 490 bp, Homo sapiens
  misc_feature: HIJSMM301DCNYB.26.23.C01.1.454.light.4.raw
  modified_base (422)..(422): a, c, t, g, unknown or other
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgttanatttattctccagcgttcggccaggggaccaaggtggaagtcaagcgaactgtggctgcaccatctgt

SEQ ID NO: 600284 - DNA, 485 bp, Homo sapiens; identical to SEQ ID NO: 535985
  misc_feature: HIJSMM301C9PGI.15.1.A01.1.454.light.4.raw

SEQ ID NO: 600285 - DNA, 487 bp, Homo sapiens
  misc_feature: HIJSMM301BYQEL.13.36.D03.1.454.light.4.raw
tcacgtactacacgaccggtgctcgatttagctgcgtcacgatctctcttggggggggtcagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggctcctcatttatggtgcatccactagggccactggtgtcccagtcaggttcagcggcagtgggtctgggacagacttcactctcaccatcagcagcctgcagtctgaagattttgcagtctattactgtcagcagtatagttactggagaaccttcggaccaagggacacgactggagattaaaggaa

SEQ ID NO: 600286 - DNA, 523 bp, Homo sapiens
  misc_feature: HIJSMM301A9XAM.27.23.C01.1.454.light.4.raw
  modified_base (438)..(438): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcattatacaaccagtnacacttgggtgttcggcggagggaccaggctgaccgtcctaggtcagcccaaggctcgccccctcggtcactctgttcccaccct

SEQ ID NO: 600287 - DNA, 486 bp, Homo sapiens; identical to SEQ ID NO: 535043
  misc_feature: HIJSMM301BC1FG.46.35.D02.1.454.light.4.raw

SEQ ID NO: 600288 - DNA, 520 bp, Homo sapiens; identical to SEQ ID NO: 537173
  misc_feature: HIJSMM301CE4SF.27.23.C01.1.454.light.4.raw

SEQ ID NO: 600289 - DNA, 484 bp, Homo sapiens; identical to SEQ ID NO: 535400
  misc_feature: HIJSMM301B7SVN.46.26.C04.1.454.light.4.raw

SEQ ID NO: 600290 - DNA, 473 bp, Homo sapiens; identical to SEQ ID NO: 538060
  misc_feature: HIJSMM301DNSIL.18.76.G10.1.454.light.4.raw

SEQ ID NO: 600291 - DNA, 491 bp, Homo sapiens
  misc_feature: HIJSMM301BEODO.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtccctcaaggttcagtggcagtggatctgggacagatttcactctcaccatccgcggtctgcaacctgaagatttcgcaacttactactgtcaacagacttacagtgcccccccgatccaccttcggccaagggacacgactggagattaaacgaactgtggctgcaccatctgtcttcatt

SEQ ID NO: 600292 - DNA, 441 bp, Homo sapiens; identical to SEQ ID NO: 535074
  misc_feature: HIJSMM301CYTQ9.11.3.A03.1.454.light.4.raw

SEQ ID NO: 600293 - DNA, 502 bp, Homo sapiens
  misc_feature: HIJSMM301EE8BS.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccc

SEQ ID NO: 600294 - DNA, 508 bp, Homo sapiens; identical to SEQ ID NO: 560095
  misc_feature: HIJSMM301B2Y0K.47.85.H08.1.454.light.4.raw

SEQ ID NO: 600295 - DNA, 505 bp, Homo sapiens; identical to SEQ ID NO: 535503
  misc_feature: HIJSMM301B2XQC.8.28.C06.1.454.light.4.raw

SEQ ID NO: 600296 - DNA, 495 bp, Homo sapiens; identical to SEQ ID NO: 556656
  misc_feature: HIJSMM301D1JVE.51.83.H06.1.454.light.4.raw

SEQ ID NO: 600297 - DNA, 489 bp, Homo sapiens
  misc_feature: HIJSMM301CT2F4.43.33.C11.1.454.light.4.raw
tgtgagtagtcacgaccggtgctcgatttagagtgagctcgttgggtttggggagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgttcaacactatgcctctcccccctacaatttcggtcaggggaccaagttgaacatcaatcgaactgtgctgcacatctgt

SEQ ID NO: 600298 - DNA, 494 bp, Homo sapiens; identical to SEQ ID NO: 534992
  misc_feature: HIJSMM301AP7DT.9.1.A01.1.454.light.4.raw

SEQ ID NO: 600299 - DNA, 522 bp, Homo sapiens
  misc_feature: HIJSMM301C2C97.48.24.C02.1.454.light.4.raw
agtatacatacacgaccggtgctcgatttagtacagatcgttagggaaaggggctgggcctaaggaagcagcactggtggtgcctcagccatggcctggaccgttctcctcctcggcctcctctctcactgcacaggctctgtgacctcctatgttctgactcagccaccctcggtgtcagtggccccaggaaagacggccaggattacctgtggaggaaacaacattggaagtaaaagtgtgcactggtaccagcagaagccaggccaggcccctgtgctggtcgtctttgatgataccgaccggccctcagggatccctgagcgattctctggctccaactctgtgaacacggccaccctgaccatcagcagggtcgaagccggggatgaggccgactattactgtcaggtgtgggatagtagtagtgatcatcctaattgggtggttcggcggagggaccaagctgaccgtcctaggtcagcccaaggctgccccctccggtcactctgttcccgccct

SEQ ID NO: 600300 - DNA, 521 bp, Homo sapiens
  misc_feature: HIJSMM301ASFCY.49.35.D02.1.454.light.4.raw
agtcgagagacacgaccggtgctcgatttagcacacgatagttgggtttgggcctaaggaagcagcactggtggtgcctcagccatggcctggaccgttctcctcctcggcctcctctctcactgcacagactctgtgacctcctatgttctgactcagccgccctcggcgtcagtggccccaggacagacggccacgattccctgtaggggagacgacattggagggaaagctgtgcattggtaccagcagaagccaggccaggcccctgagctggtcctccatggtgatagcgaccggccctcaggaatccctgagagattctccggctccaactctggggagatggccaccctgaccattaccagggccgaagccggggatgaggccgactattactgtcaggtgtgggatagtgatacggaccattgggtgttcggcggagggaccaagggtgaccgtcctaggtcagcccaaggctgccccctcggtcactctgttcccaccctcctctctctcga

SEQ ID NO: 600301 - DNA, 454 bp, Homo sapiens
  misc_feature: HIJSMM301C6XUB.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggaggggaccaagctgaccgtcctaagtcagcccaaggctgccccctcggtcactctgttccaccctcctccacgagagta

SEQ ID NO: 600302 - DNA, 465 bp, Homo sapiens; identical to SEQ ID NO: 538589
  misc_feature: HIJSMM301A9ABS.12.39.D06.1.454.light.4.raw

SEQ ID NO: 600303 - DNA, 489 bp, Homo sapiens; identical to SEQ ID NO: 535386
  misc_feature: HIJSMM301DK6CO.12.51.E07.1.454.light.4.raw

SEQ ID NO: 600304 - DNA, 454 bp, Homo sapiens; identical to SEQ ID NO: 534964
  misc_feature: HIJSMM301D1WGA.19.86.H09.1.454.light.4.raw

SEQ ID NO: 600305 - DNA, 509 bp, Homo sapiens
  misc_feature: HIJSMM301BH7CP.5.58.F03.1.454.light.4.raw
atcagacacgcacgaccggtgctcgatttagtctgatcgagaagggaaagggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtcagcccaaggccaaccccatgtcactcttcg

SEQ ID NO: 600306 - DNA, 515 bp, Homo sapiens; identical to SEQ ID NO: 595137
  misc_feature: HIJSMM301DEWPZ.17.33.C11.1.454.light.4.raw

SEQ ID NO: 600307 - DNA, 480 bp, Homo sapiens
  misc_feature: HIJSMM301CX644.13.34.D01.1.454.light.4.raw
tcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggctcctcatttatggtgcatccactagggccactggtgtcccagtcaggttcagcggcagtgggtctgggacagacttcactctcaccatcagcagcctgcagtctgaagattttgcagtctattactgtcagcagtatagttactggagaaccttcggaccaagggacacgactggagattaaaggaa

SEQ ID NO: 600308 - DNA, 491 bp, Homo sapiens; identical to SEQ ID NO: 536549
  misc_feature: HIJSMM301A1650.47.55.E11.1.454.light.4.raw

SEQ ID NO: 600309 - DNA, 509 bp, Homo sapiens
  misc_feature: HIJSMM301D7U8I.49.87.H10.1.454.light.4.raw
agtcgagagacacgaccggtgctcgatttagcagtactgcgttgggtttgggggtgggtccaggaggcagaactctgggtgtctcaccatggcctggatccctctacttctccccctcctcactctctgcacaggctctgaggcctcctatgagttgatccagccaccctcggtgtcagtgtccccaggacagacggccaggattctttgctctggagatgcgttggcaaaacagtttgcttattggttccagcagaagccaggccaagcccctgtggtggtgatttataaaggctttcagaggccctcagggatccctgagcgattctctgggtccagctcagggacaacagccaatgttgaccatcagtggagtccaggcagaagacgaggctgactattattgtcaatcagcagacaacactgttgtttctgtgttttcggcggtcgggaccaggctgaccgtcctgggtcagccaaggctgccccctcggtcactctgttcccta

SEQ ID NO: 600310 - DNA, 502 bp, Homo sapiens; identical to SEQ ID NO: 535463
  misc_feature: HIJSMM301DVX66.43.86.H09.1.454.light.4.raw

SEQ ID NO: 600311 - DNA, 478 bp, Homo sapiens
  misc_feature: HIJSMM301AM1NI.41.36.D03.1.454.light.4.raw
tctatactatcacgaccggtgctcgatttagctgcgtcacgatctctcttggggctccaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacaatcacctgcactgggaacaacaataatgtcgccaaccaaggagcagcttggctgcagcagcaccagggccaccctcccaaagtcgtatccgacagggataacaatcggcccttagggatctcagagagaatatctgcatccaggtcaggaaacacagcctcctgaccattactggactccaacctgaggacgaggctgactattattgctcagcatgggacaccagcctcaatgccgcggtattcggcgcagggaccaagctgtacccg

SEQ ID NO: 600312 - DNA, 444 bp, Homo sapiens; identical to SEQ ID NO: 538511
  misc_feature: HIJSMM301B4C8C.5.9.A09.1.454.light.4.raw
  modified_base (426)..(426): a, c, t, g, unknown or other

SEQ ID NO: 600313 - DNA, 510 bp, Homo sapiens; identical to SEQ ID NO: 569498
  misc_feature: HIJSMM301C0Z3A.40.33.C11.1.454.light.4.raw

SEQ ID NO: 600314 - DNA, 486 bp, Homo sapiens
  misc_feature: HIJSMM301D2LMZ.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtcctgacaggttcagtggcagtggatcaggcacagattttacactgaaaatcagcagagtggaggctgaggatgttggggtttattactgcatgcaagctctacaaactccttacacttttggccaggggaccaagctggagatcaaacgaa

SEQ ID NO: 600315 - DNA, 477 bp, Homo sapiens
  misc_feature: HIJSMM301DDWL3.7.67.G01.1.454.light.4.raw
cgtgtctctacacgaccggtgctcgatttagagtatacatattgggtttgggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctcccacagcggggcaggttctgatgttcactggtaccagcagcttccagggacagcccccaaactcctcatatacgagaacaccaatcggccctcaggagtccctgaccgattctctggctccaagtctggcacctcagcctccctggccatcactgggctccaggctgaggatggaggctgattattactgccagtcgtatgacagcagcctgagtgttgggtgttcggcggaggga

SEQ ID NO: 600316 - DNA, 497 bp, Homo sapiens; identical to SEQ ID NO: 535286
  misc_feature: HIJSMM301C2NEW.18.59.F04.1.454.light.4.raw

SEQ ID NO: 600317 - DNA, 491 bp, Homo sapiens
  misc_feature: HIJSMM301DAVOY.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgaggggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaaggccaaccccactgt

SEQ ID NO: 600318 - DNA, 494 bp, Homo sapiens
  misc_feature: HIJSMM301B9BOB.40.53.E09.1.454.light.4.raw
tctagcgactcacgaccggtgctcgatttagagagagtgtgttgggtttgggggctggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgctgctcttatgcaggcagtttcgctctcgaagtgttcggcggagggaccgagctgaccgtcctacgtcagcccaa

SEQ ID NO: 600319 - DNA, 510 bp, Homo sapiens; identical to SEQ ID NO: 542037
  misc_feature: HIJSMM301AJJ7P.4.57.F02.1.454.light.4.raw

SEQ ID NO: 600320 - DNA, 484 bp, Homo sapiens; identical to SEQ ID NO: 536162
  misc_feature: HIJSMM301CNRW0.13.59.F04.1.454.light.4.raw

SEQ ID NO: 600321 - DNA, 480 bp, Homo sapiens; identical to SEQ ID NO: 540683
  misc_feature: HIJSMM301CJZZC.41.5.A05.1.454.light.4.raw

SEQ ID NO: 600322 - DNA, 487 bp, Homo sapiens
  misc_feature: HIJSMM301CF197.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggaccgttcggccaagggaccaacggtggaaagtacaaacgaactagtggctgcaccta

SEQ ID NO: 600323 - DNA, 508 bp, Homo sapiens
  misc_feature: HIJSMM301B0XTQ.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccggacgtcgccacggaccgaaggtggaagtacaaacgaactagtggctgcaccatctgtcttctactcttcccgccctact

SEQ ID NO: 600324 - DNA, 491 bp, Homo sapiens; identical to SEQ ID NO: 577242
  misc_feature: HIJSMM301DYZP6.16.68.G02.1.454.light.4.raw

SEQ ID NO: 600325 - DNA, 486 bp, Homo sapiens; identical to SEQ ID NO: 537144
  misc_feature: HIJSMM301BQZU0.46.35.D02.1.454.light.4.raw

SEQ ID NO: 600326 - DNA, 507 bp, Homo sapiens; identical to SEQ ID NO: 535641
  misc_feature: HIJSMM301CF3ZB.10.88.H11.1.454.light.4.raw

SEQ ID NO: 600327 - DNA, 490 bp, Homo sapiens; identical to SEQ ID NO: 535119
  misc_feature: HIJSMM301D46W6.51.71.G05.1.454.light.4.raw

SEQ ID NO: 600328 - DNA, 494 bp, Homo sapiens; identical to SEQ ID NO: 534994
  misc_feature: HIJSMM301CTOJY.27.78.H01.1.454.light.4.raw

SEQ ID NO: 600329 - DNA, 497 bp, Homo sapiens
  misc_feature: HIJSMM301EGWUO.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggaggaccaagggtggagatcaaacgactgtggctgcaccatctgtcttcatccttcccgccatctgac

SEQ ID NO: 600330 - DNA, 508 bp, Homo sapiens
  misc_feature: HIJSMM301BAPY3.3.79.H02.1.454.light.4.raw
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaagcccccaaactcatcatttatgatgtcactgctcggccctcaggggtttctcatcgctttttctggctccaagtctggcaccacggcctccctgaccatctcggggctccaggctgaggacgaggctgcttattactgcagctcatatacaaggagcaccactctcgtggtatttggtggagggaccaagctgaccgtcctaggtcagcccaaggctgccccctcggt

SEQ ID NO: 600331 - DNA, 505 bp, Homo sapiens
  misc_feature: HIJSMM301CARKK.18.78.H01.1.454.light.4.raw
  modified_base (321)..(321): a, c, t, g, unknown or other
  modified_base (500)..(500): a, c, t, g, unknown or other
tacgagtatgcacgaccggtgctcgatttagtgtgagtagtttgggtttggggggggtctcaggaggcagcactctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctnaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtccaccgtcctaggtcagcccaaggccaacccntgtca

SEQ ID NO: 600332 - DNA, 462 bp, Homo sapiens
  misc_feature: HIJSMM301C2PGP.49.10.A10.1.454.light.4.raw
agtcgagagacacgaccggtgctcgatttagcgtcgatctcagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcggggggaccaaggtggagatcaagcgaa

SEQ ID NO: 600333 - DNA, 505 bp, Homo sapiens
  misc_feature: HIJSMM301CQ4R3.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgcagtttattactgtcagcagtataatgactgggttttattcactttcggtccctcgggtaccgaaacgtaggagttctagacggaacctagtggcgtgcaccaactctgtcttcta

SEQ ID NO: 600334 - DNA, 511 bp, Homo sapiens
  misc_feature: HIJSMM301AR3I0.3.37.D04.1.454.light.4.raw
agacgcactccacgaccggtgctcgatttagtagcatactgttgggtttggggggggtctcagggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccagcagtgacgttggtagatataattatgtctcctggtaccaacaactcccaggcaaagcccccaaactgatgatttatgatgtcaataatcggccctcaggggtttctaatcgcttctctggctccaagtctggcaacacggcctccctgaccatctctgggctccagggtgaggacgaggctgatttattactgcagctcatttacaagcagcaccactcaggtcttcggaactgggactaaggtcaccgtcctaggtcagcccaaggccaacccccatgtccact

SEQ ID NO: 600335 - DNA, 505 bp, Homo sapiens; identical to SEQ ID NO: 542781
  misc_feature: HIJSMM301AGSWU.4.57.F02.1.454.light.4.raw

SEQ ID NO: 600336 - DNA, 475 bp, Homo sapiens
  misc_feature: HIJSMM301D1DPI.4.54.E10.1.454.light.4.raw
agcactgtagcacgaccggtgctcgatttagatcgtagcagaacacacaaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcagcatcacttgccgggcaagtcagagcattagctacttttttaagttggtatcagcagacaccagggaaagcccctaagctcctgatctatgctgcttccagtttgcaaagtgggtcccatcaaggttcagtggcagtggatctgggacagatttcactctcactgtcagcagtctgcaatttgaagattttgctaacttactactgtcaacagagtttcagtatcccttggactttcggccaagggaccaaggtaggaaatacaaacgaa

SEQ ID NO: 600337 - DNA, 491 bp, Homo sapiens; identical to SEQ ID NO: 550287
  misc_feature: HIJSMM301A65VY.14.36.D03.1.454.light.4.raw

SEQ ID NO: 600338 - DNA, 512 bp, Homo sapiens
  misc_feature: HIJSMM301DNZLX.43.19.B08.1.454.light.4.raw
tgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctcggtcactctgttcccgcctcctcta

SEQ ID NO: 600339 - DNA, 454 bp, Homo sapiens; identical to SEQ ID NO: 535005
  misc_feature: HIJSMM301DK97X.19.86.H09.1.454.light.4.raw

SEQ ID NO: 600340 - DNA, 486 bp, Homo sapiens; identical to SEQ ID NO: 537428
  misc_feature: HIJSMM301C98MZ.47.62.F07.1.454.light.4.raw

SEQ ID NO: 600341 - DNA, 517 bp, Homo sapiens
  misc_feature: HIJSMM301BADTA.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccgaagggggacgggatccccgatcgcttcatgggctccagttctggggctgaccgctacctcaccatctccaacctccagtctgacgatgaggctgagtatcactgtggagagagccacacaattgaatggccaagacgggttgggtgttcggcggagggaccaaggctgaccgtcctaggtcagcccaaggctgccccctcggtcactctgttcccgccctcctcgctacgtaga

SEQ ID NO: 600342 - DNA, 484 bp, Homo sapiens; identical to SEQ ID NO: 535240
  misc_feature: HIJSMM301CARS7.47.60.F05.1.454.light.4.raw

SEQ ID NO: 600343 - DNA, 444 bp, Homo sapiens; identical to SEQ ID NO: 535027
  misc_feature: HIJSMM301D6SL2.8.73.G07.1.454.light.4.raw

SEQ ID NO: 600344 - DNA, 467 bp, Homo sapiens
  misc_feature: HIJSMM301D0GB8.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaaatttggaaacagaggtcccaccgaggttcagtggaagtggatctgggacagactttactctcaccatcagcagcctgcagcctgaagatattgcaacatattactgtcaacagtatgatcgtctcctcaatttcggccctgggacccagagtggacatgaaaacggaa

SEQ ID NO: 600345 - DNA, 497 bp, Homo sapiens
  misc_feature: HIJSMM301DXG07.47.66.F11.1.454.light.4.raw
agctcacgtacacgaccggtgctcgatttagtcacgcgagaagggggaggaactgctcagttaggacccagagggaaccatggaagccccagctcagcttctcttcctcctgctactctggctcccagaaatcgccggagacattctattgacacaggctccagtcaccctgtctttgtctccaggggaaagagccaccctctcctgcagggccagtcaaagcatcggcaacaatttggcctggtatcaacagaaacctggccaggctcccaggctcctcatctacgatgcatccaacagggccactggcgtcccaggcaggttcagaggcgtgggtctgggacagacttcactctcaccattgacggcctagagcctgaagattttgcagtttattactgtcagcagcgtaacaattgccgatcaccttcggccaagggacacgactggagattaaacgaactgtgctgcaccatctgtcttcatcttcccgccat

SEQ ID NO: 600346 - DNA, 496 bp, Homo sapiens
  misc_feature: HIJSMM301BVMFS.41.53.E09.1.454.light.4.raw
tctatactatcacgaccggtgctcgatttagagagagtgtgttgggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcgggcggagggaccaagctgaccgtcctaggtcagcccaagg

SEQ ID NO: 600347 - DNA, 473 bp, Homo sapiens; identical to SEQ ID NO: 535262
  misc_feature: HIJSMM301EZSKY.8.67.G01.1.454.light.4.raw

SEQ ID NO: 600348 - DNA, 517 bp, Homo sapiens
  misc_feature: HIJSMM301D5BPN.40.12.B01.1.454.light.4.raw
tctagcgactcacgaccggtgctcgatttagtagtgtagattccgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctgggcaacacggcctccctgaccgtctctgggctccaggctgaagatgaggctgattattactgctactcgtatgcaggcggcaacaattgggtcttcggcggaggggaccaaggctgaccgtcctaggtcagcccaaggctgccccctcggtcactctgttcccg

SEQ ID NO: 600349 - DNA, 488 bp, Homo sapiens; identical to SEQ ID NO: 541164
  misc_feature: HIJSMM301A2S92.26.45.E01.1.454.light.4.raw

SEQ ID NO: 600350 - DNA, 490 bp, Homo sapiens; identical to SEQ ID NO: 541129
  misc_feature: HIJSMM301DZT7Q.16.68.G02.1.454.light.4.raw

SEQ ID NO: 600351 - DNA, 384 bp, Homo sapiens
  misc_feature: HIJSMM301BVFWM.48.27.C05.1.454.light.4.raw
agtatacatacacgaccggtgctcgatttagacgcgatcgaagggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcacca

SEQ ID NO: 600352 - DNA, 503 bp, Homo sapiens
  misc_feature: HIJSMM301DMUF8.48.45.E01.1.454.light.4.raw
agtatacatacacgaccggtgctcgatttagtgagtcagtaagggaaagggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagtacttttagtttacgtcggaccttcggccaagggacacgactggagattaaacgaactgtggctgcaccatcttgtcttctatcttccccg

SEQ ID NO: 600353 - DNA, 506 bp, Homo sapiens
  misc_feature: HIJSMM301EGZI8.9.71.G05.1.454.light.4.raw
tgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggcctgtccccccg

SEQ ID NO: 600354 - DNA, 485 bp, Homo sapiens
  misc_feature: HIJSMM301DGYNI.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagtattttgcactttattactgtcagcagcgtagcaactggcctctcactttcggcggagggaccgagggtggagatcagacgaa

SEQ ID NO: 600355 - DNA, 501 bp, Homo sapiens; identical to SEQ ID NO: 535873
  misc_feature: HIJSMM301DUFU5.17.27.C05.1.454.light.4.raw

SEQ ID NO: 600356 - DNA, 503 bp, Homo sapiens
  misc_feature: HIJSMM301BYTNC.40.9.A09.1.454.light.4.raw
tctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcaccatcagcggcctgcaggctgaagatgtggcagtttattactgtcagcactgttttggcggttctccgactttcggcggagggaccaaggtggaggtcaacgaactgtggctgcgccatctgtcttcta

SEQ ID NO: 600357 - DNA, 516 bp, Homo sapiens; identical to SEQ ID NO: 542229
  misc_feature: HIJSMM301CRIIO.3.87.H10.1.454.light.4.raw

SEQ ID NO: 600358 - DNA, 346 bp, Homo sapiens
  misc_feature: HIJSMM301CPVT4.21.87.H10.1.454.light.4.raw
tcgtcgctcgcacgaccggtgctcgatttagcagtactgcgttgggttttaaccttgtctcctggtatcaacaacaccaggacaaagccccaaaactcttaatttctggcgtcaatcagcgaccctcacatgtttccagtcgattctctgcatccaagtctggcaacacggcctttctgacaatctctcaactccaggctgaagacgaggctatttattactgctcctcatacgcaggtggcacattttttcttggttttttggcggcgggacccagatgactgtcctcagtcagcccaaggctgccccctcggtcactctgttcccaccctcctccgagcgacga

SEQ ID NO: 600359 - DNA, 493 bp, Homo sapiens; identical to SEQ ID NO: 535745
  misc_feature: HIJSMM301EEMGW.47.78.H01.1.454.light.4.raw

SEQ ID NO: 600360 - DNA, 484 bp, Homo sapiens; identical to SEQ ID NO: 535240
  misc_feature: HIJSMM301DCI6H.47.60.F05.1.454.light.4.raw

SEQ ID NO: 600361 - DNA, 506 bp, Homo sapiens; identical to SEQ ID NO: 534969
  misc_feature: HIJSMM301EIENA.18.37.D04.1.454.light.4.raw

SEQ ID NO: 600362 - DNA, 502 bp, Homo sapiens; identical to SEQ ID NO: 539002
  misc_feature: HIJSMM301EINUX.18.59.F04.1.454.light.4.raw

SEQ ID NO: 600363 - DNA, 502 bp, Homo sapiens
  misc_feature: HIJSMM301B5DZC.3.70.G04.1.454.light.4.raw
agacgcactccacgaccggtgctcgatttagtgtagtgtgaagggaaagggggaggaactgctcagttaggacccagagggaaccatggaagccccagctcagcttctcttcctcctgctactctggctcccagataacaccggacaaactgtgttgacacagtctccagccaccctgtctttgtccccaggggagacagccaccctctcctgcagggccagtcagagtgttagggccacttagcctggtaccagcagaaacctggccagcctcccagtctcctcatctatggagcacacaacagggccactggcatcccagccaggttcagtggcagtgggtctgggacagacttcaccctcatcatcagccgcctagagcctgaagattttgcagtttattactgtcagcagggttacttctggcccactttcggccctgggaccaaagtggatatcaaacgaactgtggctgcaccatctgtcttcatcttcccgccat

SEQ ID NO: 600364 - DNA, 509 bp, Homo sapiens
  misc_feature: HIJSMM301CZKKV.43.9.A09.1.454.light.4.raw
tgtgagtagtcacgaccggtgctcgatttagcgagacgcgcaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggaactgtcaccagtggtcattatccctactggttccagcagaagcctggccaggccccccggacactgatttatgatacaagcaacaaactttcctggacacctgcccgattctcaggctccctccttgggacaaagctgccctgaccctttcgggtgcgcagcctgaggatgaggctgactattactgcttgctcgcctatgatgctgctcgggtttcggcggagggaccaagttgaccgtcctagtcagcccaaggctgccccctcggtcactctgttcccgccctcctcta

SEQ ID NO: 600365 - DNA, 493 bp, Homo sapiens
  misc_feature: HIJSMM301DZA03.48.1.A01.1.454.light.4.raw
agtatacatacacgaccggtgctcgatttagacgtctcatcagggggcaggagtcagacccagtcaggactcagcatggacatgagggtccccgctcagctcctggggcctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatctggggcagagttcattctcaccatcaacagccttcagcctgaagattttgcaacttactattgtcagcagggtgacagtttccctcccactttcggcggagggaccagggtggacgtcaaacgaactgtggctgcaccatctgtcttcatt

SEQ ID NO: 600366 - DNA, 493 bp, Homo sapiens
  misc_feature: HIJSMM301BS43F.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagcccaccctctcctgcagggccagtcagagtgttgacagcaacttggcctggtaccagcagcaacctggccaggctcccaggctcctcatctatgatgcatccaccagggcccaccggtatcccagccaggttcagtggcaggtgggtctgggacagagttcactctcaccatcagcagcctgcagtctgaggtatttgcagtttattactgtcagcattacaataactggcctcggctcactttcggcggacgggaccgaaggtggagatacaaacgaactgtggctgcaccat

SEQ ID NO: 600367 - DNA, 511 bp, Homo sapiens; identical to SEQ ID NO: 550438
  misc_feature: HIJSMM301DEJYC.17.33.C11.1.454.light.4.raw

SEQ ID NO: 600368 - DNA, 498 bp, Homo sapiens; identical to SEQ ID NO: 535295
  misc_feature: HIJSMM301C4YYL.15.25.C03.1.454.light.4.raw

SEQ ID NO: 600369 - DNA, 494 bp, Homo sapiens; identical to SEQ ID NO: 554605
  misc_feature: HIJSMM301EZH0M.5.57.F02.1.454.light.4.raw

SEQ ID NO: 600370 - DNA, 445 bp, Homo sapiens; identical to SEQ ID NO: 546083
  misc_feature: HIJSMM301EUJ1D.5.9.A09.1.454.light.4.raw

SEQ ID NO: 600371 - DNA, 497 bp, Homo sapiens; identical to SEQ ID NO: 534982
  misc_feature: HIJSMM301BAV38.26.80.H03.1.454.light.4.raw

SEQ ID NO: 600372 - DNA, 497 bp, Homo sapiens; identical to SEQ ID NO: 535740
  misc_feature: HIJSMM301C374C.3.71.G05.1.454.light.4.raw

SEQ ID NO: 600373 - DNA, 502 bp, Homo sapiens
  misc_feature: HIJSMM301ADXCL.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccgaaggaccgaaggtaggaaatacaaacgaactagtggctgcacc

SEQ ID NO: 600374 - DNA, 484 bp, Homo sapiens; identical to SEQ ID NO: 535240
  misc_feature: HIJSMM301DREO2.47.60.F05.1.454.light.4.raw

SEQ ID NO: 600375 - DNA, 421 bp, Homo sapiens; identical to SEQ ID NO: 541597
  misc_feature: HIJSMM301BOVIG.41.82.H05.1.454.light.4.raw

SEQ ID NO: 600376 - DNA, 497 bp, Homo sapiens
  misc_feature: HIJSMM301A2STP.27.78.H01.1.454.light.4.raw
  modified_base (427)..(427): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtacttactttaccncaagtgatcacccttcggccaagggacacgactggagaattaaacgaactgtggctgcaccatctgtctt

SEQ ID NO: 600377 - DNA, 509 bp, Homo sapiens
  misc_feature: HIJSMM301C6M0X.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctcgggaccaaacttagagatcaaacgaactgtggctgcaccatctgtcttcatcttcccgccact

SEQ ID NO: 600378 - DNA, 488 bp, Homo sapiens; identical to SEQ ID NO: 554863
  misc_feature: HIJSMM301A76JX.12.51.E07.1.454.light.4.raw

SEQ ID NO: 600379 - DNA, 508 bp, Homo sapiens
  misc_feature: HIJSMM301EK1SR.5.58.F03.1.454.light.4.raw
atcagacacgcacgaccggtgctcgatttagtctgatcgagaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgtttcgggactgggaccaaggtcaccgtcctaggtcagcccaaggccaacccactgtcact

SEQ ID NO: 600380 - DNA, 495 bp, Homo sapiens
  misc_feature: HIJSMM301B2L15.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatggttgggtttattactgcatgcaagctctacaaactccttactacttttggtccgaggggaccaagcgtggagatacaaacgaacta

SEQ ID NO: 600381 - DNA, 508 bp, Homo sapiens
  misc_feature: HIJSMM301EPKUD.9.12.B01.1.454.light.4.raw
  modified_base (492)..(492): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccacggaccgaacggtggaaagtacaaacgaactagtggctcgcaccatctntcttctatcttccccg

SEQ ID NO: 600382 - DNA, 497 bp, Homo sapiens; identical to SEQ ID NO: 535664
  misc_feature: HIJSMM301AOMB7.22.14.B03.1.454.light.4.raw

SEQ ID NO: 600383 - DNA, 503 bp, Homo sapiens; identical to SEQ ID NO: 582321
  misc_feature: HIJSMM301ENGCD.21.22.B11.1.454.light.4.raw

SEQ ID NO: 600384 - DNA, 504 bp, Homo sapiens
  misc_feature: HIJSMM301COB95.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaaggctgaccgtcctgcgtcagcccaaggctgccccctcggtcactcc

SEQ ID NO: 600385 - DNA, 447 bp, Homo sapiens; identical to SEQ ID NO: 535201
  misc_feature: HIJSMM301CXQY1.18.9.A09.1.454.light.4.raw

SEQ ID NO: 600386 - DNA, 510 bp, Homo sapiens
  misc_feature: HIJSMM301D8YBZ.11.57.F02.1.454.light.4.raw
cgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaaggaccaaggtggaagtcaagcgaactgtggctgcaccatctgtcttcatcttcccgcc

SEQ ID NO: 600387 - DNA, 483 bp, Homo sapiens; identical to SEQ ID NO: 587070
  misc_feature: HIJSMM301CVH99.3.88.H11.1.454.light.4.raw

SEQ ID NO: 600388 - DNA, 487 bp, Homo sapiens
  misc_feature: HIJSMM301D97CK.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcgacagagttacggtaccccgtacacttttggccaggggaccaaactggacatcaaacgaactgtggctgcaccatctgt

SEQ ID NO: 600389 - DNA, 486 bp, Homo sapiens; identical to SEQ ID NO: 537127
  misc_feature: HIJSMM301BRAAX.3.77.G11.1.454.light.4.raw

SEQ ID NO: 600390 - DNA, 508 bp, Homo sapiens; identical to SEQ ID NO: 541908
  misc_feature: HIJSMM301D4VTU.47.85.H08.1.454.light.4.raw

SEQ ID NO: 600391 - DNA, 447 bp, Homo sapiens; identical to SEQ ID NO: 535201
  misc_feature: HIJSMM301D8TYE.18.9.A09.1.454.light.4.raw

SEQ ID NO: 600392 - DNA, 498 bp, Homo sapiens
  misc_feature: HIJSMM301CLMEZ.48.35.D02.1.454.light.4.raw
agtatacatacacgaccggtgctcgatttagcacacgatagttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtctaggtcagcccaaggctccg

SEQ ID NO: 600393 - DNA, 507 bp, Homo sapiens
  misc_feature: HIJSMM301EUNFY.43.59.F04.1.454.light.4.raw
tgtgagtagtcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaacccactgtcact

SEQ ID NO: 600394 - DNA, 514 bp, Homo sapiens; identical to SEQ ID NO: 543100
  misc_feature: HIJSMM301DEAXH.8.23.C01.1.454.light.4.raw

SEQ ID NO: 600395 - DNA, 488 bp, Homo sapiens; identical to SEQ ID NO: 537408
  misc_feature: HIJSMM301B9QCE.26.55.E11.1.454.light.4.raw

SEQ ID NO: 600396 - DNA, 494 bp, Homo sapiens; identical to SEQ ID NO: 535828
  misc_feature: HIJSMM301E1IK3.3.36.D03.1.454.light.4.raw

SEQ ID NO: 600397 - DNA, 478 bp, Homo sapiens; identical to SEQ ID NO: 541545
  misc_feature: HIJSMM301BYW4L.10.74.G08.1.454.light.4.raw

SEQ ID NO: 600398 - DNA, 490 bp, Homo sapiens; identical to SEQ ID NO: 535420
  misc_feature: HIJSMM301DY9RS.3.72.G06.1.454.light.4.raw

SEQ ID NO: 600399 - DNA, 491 bp, Homo sapiens
  misc_feature: HIJSMM301ENK0C.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacacgtacccccctcacctttcggcggagggaccgaaggcggagatcagacgaactgtggctgcacatctgtcttcta

SEQ ID NO: 600400 - DNA, 479 bp, Homo sapiens; identical to SEQ ID NO: 536513
  misc_feature: HIJSMM301ANNEC.40.8.A08.1.454.light.4.raw

SEQ ID NO: 600401 - DNA, 486 bp, Homo sapiens; identical to SEQ ID NO: 535290
  misc_feature: HIJSMM301CQQXG.3.12.B01.1.454.light.4.raw

SEQ ID NO: 600402 - DNA, 465 bp, Homo sapiens
  misc_feature: HIJSMM301AVMTQ.48.2.A02.1.454.light.4.raw
agtatacatacacgaccggtgctcgatttagactcatctacagggggcaggagtcagacccactcaggacacagcatggacatgagggtccccgctcagctcctgggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgctcggccaggggaccaaagtggatgtcaaccgaa

SEQ ID NO: 600403 - DNA, 493 bp, Homo sapiens
  misc_feature: HIJSMM301BJBPG.19.25.C03.1.454.light.4.raw
tactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggcctcagactttcggcggagggaccaaggtgggagatcaaacgaactagtggctgcaccatctgtt

SEQ ID NO: 600404 - DNA, 482 bp, Homo sapiens; identical to SEQ ID NO: 535352
  misc_feature: HIJSMM301BINYH.16.81.H04.1.454.light.4.raw

SEQ ID NO: 600405 - DNA, 501 bp, Homo sapiens; identical to SEQ ID NO: 536818
  misc_feature: HIJSMM301BVPCI.12.82.H05.1.454.light.4.raw

SEQ ID NO: 600406 - DNA, 383 bp, Homo sapiens; identical to SEQ ID NO: 540698
  misc_feature: HIJSMM301A33US.41.28.C06.1.454.light.4.raw

SEQ ID NO: 600407 - DNA, 498 bp, Homo sapiens
  misc_feature: HIJSMM301CYZP5.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggttcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaactgtggctgcaccatctgtcttcatcttccccg

SEQ ID NO: 600408 - DNA, 488 bp, Homo sapiens
  misc_feature: HIJSMM301B60DS.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgacccgattcagtggcagcgggtctgggacagatttcactctcaccatcagcagcctgcaggctgaagatgtggcagttttattattgtcaacaatattattatacttcgtggaccgttggccaagggaccaaggtggatatcagacgaa

SEQ ID NO: 600409 - DNA, 514 bp, Homo sapiens
  misc_feature: HIJSMM301C4K9J.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaactcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggtccaacgggaccgaacggtaggaaagtacgaagacgaactagtggcgtgcaccatctgtcttctactcttcccgt

SEQ ID NO: 600410 - DNA, 479 bp, Homo sapiens
  misc_feature: HIJSMM301AHEJM.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagattttgtaacttactattgtcaacaggctaacagtttcccgctcaccttcggcgggggaccaaggtggagatcaacgaactgtggctgcaccat

SEQ ID NO: 600411 - DNA, 495 bp, Homo sapiens; identical to SEQ ID NO: 536055
  misc_feature: HIJSMM301B06FY.47.38.D05.1.454.light.4.raw

SEQ ID NO: 600412 - DNA, 494 bp, Homo sapiens
  misc_feature: HIJSMM301CCK09.22.86.H09.1.454.light.4.raw
acatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattatactgctgctcatttgcaggcgcctacacttgggtgttcggcggagggaccaaggctgaccgtcctaggtcagcccaaggctgccccctcggtcactctgttcccaccctcctcacgcg

SEQ ID NO: 600413 - DNA, 475 bp, Homo sapiens
  misc_feature: HIJSMM301CBRJS.3.1.A01.1.454.light.4.raw
agacgcactccacgaccggtgctcgatttagacgtctcatcagggggagtcagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggcaacttattactgccaacagtatgatagttattggacgttcggccaagggaccaagatagaaatacaaacgaactgtggctgcaccat

SEQ ID NO: 600414 - DNA, 480 bp, Homo sapiens; identical to SEQ ID NO: 571124
  misc_feature: HIJSMM301C15CZ.17.39.D06.1.454.light.4.raw

SEQ ID NO: 600415 - DNA, 486 bp, Homo sapiens
  misc_feature: HIJSMM301CT27F.22.73.G07.1.454.light.4.raw
acatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtatccccgccaggttcagtgccagtgggtctgggacaggagttcactctcaccatcagcagcctgcagtctgaagattttgcactttattactgtcagcaatataatgactggttctcgatcaccttcggccaagggacacgactggagattaaacgaactgtgctgcaccatctgt

SEQ ID NO: 600416 - DNA, 501 bp, Homo sapiens
  misc_feature: HIJSMM301BAOL5.10.65.F10.1.454.light.4.raw
catagtagtgcacgaccggtgctcgatttagctacgctctaagggggagtcagtcgtcagtcaggacacagcatggacatgagggtcccccgctcagctcctggggctcctgctactctggctccgaggtgccagatgtgacatccagatgacccagtctccaccgtccctgtcctgcatttgttggagacagagtcaccatctcttgccggacaagtcagaacattgacacctatttgaattggtatcaacaaaaactggggaaagcccctacactcctgatcaatgcagcgtccagtttacagagtggggtcccctcaaggttcagtggcagtggatctgggacagactttactctcaccatcagcgatctgcagcctgacgattttgcgacttactacttgtcaactagagtttccggaaccccgttactttcggcgagggaccaaggtggagatcaaacgaactgtggctgcaccatctgtcttcatcttcccgcta

SEQ ID NO: 600417 - DNA, 499 bp, Homo sapiens; identical to SEQ ID NO: 542528
  misc_feature: HIJSMM301C3U9O.52.34.D01.1.454.light.4.raw

SEQ ID NO: 600418 - DNA, 447 bp, Homo sapiens; identical to SEQ ID NO: 535020
  misc_feature: HIJSMM301A1J6U.18.9.A09.1.454.light.4.raw

SEQ ID NO: 600419 - DNA, 509 bp, Homo sapiens; identical to SEQ ID NO: 548565
  misc_feature: HIJSMM301BZI6U.40.48.E04.1.454.light.4.raw

SEQ ID NO: 600420 - DNA, 489 bp, Homo sapiens
  misc_feature: HIJSMM301CI8C1.41.44.D11.1.454.light.4.raw
tctatactatcacgaccggtgctcgatttagcgcagtacgaagggggctgcgggggtaagaggttgtgtccaccatggcctggactcctctcctcctcctgttcctctctcactgcacaggttccctctcgcaggctgtgctgactcagccgtcttccctctctgcatctcctggagcatcagtcagtctcacctgcaccttgcgcagtggcatcgatgttaataggtacacgatatattggtaccagaggaggccagggagtcctccccaatttctcctgagctacaagtcacagtcagatacacagcggggctctggagtccccagacgcttctctggattcaaagatgtttcggccaatgcaggcattttagtcatctctggggtccagtttgtggatgaggctgactactattgcacggtctggtacagcagcgctgtggtcttcggcggagggacgtgaacttatcgtcctaggtcagcccaac

SEQ ID NO: 600421 - DNA, 516 bp, Homo sapiens; identical to SEQ ID NO: 573129
  misc_feature: HIJSMM301BU81H.41.25.C03.1.454.light.4.raw

SEQ ID NO: 600422 - DNA, 498 bp, Homo sapiens
  misc_feature: HIJSMM301EM6Y5.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccgagggtggaaagtcaaacgaactagtggctgcaccatctgtcttcatt

SEQ ID NO: 600423 - DNA, 497 bp, Homo sapiens
  misc_feature: HIJSMM301AH4YD.26.37.D04.1.454.light.4.raw
agactatactcacgaccggtgctcgatttagtagcatactgttgggtttggggggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcaggtgggtctgggacagtagttcactctcaccatcagcagcctgcagtctagaagattgtgctaatttattactgtcagcaatataatacctggcctccgcctcacgtttcggacggacgggaccgaaggttgagactacaaacgaactgtggctcgcacc

SEQ ID NO: 600424 - DNA, 523 bp, Homo sapiens
  misc_feature: HIJSMM301AS17S.27.23.C01.1.454.light.4.raw
agcgtcgtctcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtggttcggcggagggaccaggctgaccgtcctaggtcagcccaaggctgccccctcggtcactctgttcccgccct

SEQ ID NO: 600425 - DNA, 493 bp, Homo sapiens
  misc_feature: HIJSMM301EJIMD.49.85.H08.1.454.light.4.raw
agtcgagagacacgaccggtgctcgatttagtatcactcagtcgcgggcacgaccggtgctcgatttagagctcacgtattgggtttggggagagctctggggaggaactgctcagttaggacccagacggaaccatggaagccccagcgcagcttctcttcctcctgctactctggctcccagagaccactggagaaatagcgatgacgcagtctccagccaccctgtctgtgtctccagggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattacttgtcagcagtataattactggctcgttttggtccg

SEQ ID NO: 600426 - DNA, 496 bp, Homo sapiens
  misc_feature: HIJSMM301CR44T.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaagg

SEQ ID NO: 600427 - DNA, 505 bp, Homo sapiens
  misc_feature: HIJSMM301B9QKO.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggaggaccgaaggtggacctcaaacgaactgtggctgcaccatctgtcttcatcttcccgcc

SEQ ID NO: 600428 - DNA, 484 bp, Homo sapiens; identical to SEQ ID NO: 536162
  misc_feature: HIJSMM301AY4Q5.13.59.F04.1.454.light.4.raw

SEQ ID NO: 600429 - DNA, 483 bp, Homo sapiens; identical to SEQ ID NO: 555750
  misc_feature: HIJSMM301CF2DL.41.78.H01.1.454.light.4.raw

SEQ ID NO: 600430 - DNA, 504 bp, Homo sapiens
  misc_feature: HIJSMM301D13BI.14.57.F02.1.454.light.4.raw
cgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggccgctcactttcggcggggggaccaaggtggagttcaaacgaactgtggctgcaccatctgtcttcatcttcccgt

SEQ ID NO: 600431 - DNA, 486 bp, Homo sapiens; identical to SEQ ID NO: 535917
  misc_feature: HIJSMM301BJCLC.3.10.A10.1.454.light.4.raw

SEQ ID NO: 600432 - DNA, 497 bp, Homo sapiens
  misc_feature: HIJSMM301AIM85.3.31.C09.1.454.light.4.raw
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcaactacttagcctggtaccaacagaaacctggccaggctcccaggctcctcatctatgatgcatccaacagggccactggcatcccagccaggttcggtggcagtgggtctgggacagacttcactctcaccatcagcagcctagagcctgaagattttgcagtttattactgtcagcagcgtagcaactggcctctcactttcggcggagggaccgaaggtggagatcaaacgaactgtggctgcaccatctgtcttc

SEQ ID NO: 600433 - DNA, 514 bp, Homo sapiens; identical to SEQ ID NO: 585705
  misc_feature: HIJSMM301ETGQN.48.37.D04.1.454.light.4.raw

SEQ ID NO: 600434 - DNA, 505 bp, Homo sapiens; identical to SEQ ID NO: 542781
  misc_feature: HIJSMM301AOF3W.4.57.F02.1.454.light.4.raw

SEQ ID NO: 600435 - DNA, 488 bp, Homo sapiens; identical to SEQ ID NO: 535990
  misc_feature: HIJSMM301BWLAZ.11.28.C06.1.454.light.4.raw

SEQ ID NO: 600436 - DNA, 515 bp, Homo sapiens
  misc_feature: HIJSMM301DOP6U.15.86.H09.1.454.light.4.raw
tctacgtagccacgaccggtgctcgatttagtgctatagacttgggtttgggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaatttgatggccaaggacggttgggtgttcggcggagggaccaagctgaccgtcctaggtcagcccaaggctgccccctggtcactctgttcccacctcctcgctacgtaga

SEQ ID NO: 600437 - DNA, 504 bp, Homo sapiens; identical to SEQ ID NO: 538423
  misc_feature: HIJSMM301AU3PH.48.67.G01.1.454.light.4.raw

SEQ ID NO: 600438 - DNA, 489 bp, Homo sapiens
  misc_feature: HIJSMM301BC7ED.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggtccaacgggaccaaggtggagtatcagacgaa

SEQ ID NO: 600439 - DNA, 481 bp, Homo sapiens
  misc_feature: HIJSMM301CQ728.49.49.E05.1.454.light.4.raw
agtcgagagacacgaccggtgctcgatttagagcgactagcaacacacaaaggggtctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcctgcactgggagcagctccaacatcggggcaggttatgatgtacactggtatcagcagcttcccggaacacgccccaaactcctcatctatgatgacattaagcggcccgtcgggggtccctgaccgattctctggctccaagtctggcaccgcagcctcctggccatcacgtggctccaggctggaggatgaggctgattattactgccagacctatgacaccagcctgactgtcgtggtcttcggcggaggaaccg

SEQ ID NO: 600440 - DNA, 519 bp, Homo sapiens; identical to SEQ ID NO: 591108
  misc_feature: HIJSMM301AY22P.7.86.H09.1.454.light.4.raw

SEQ ID NO: 600441 - DNA, 509 bp, Homo sapiens; identical to SEQ ID NO: 553073
  misc_feature: HIJSMM301BHHOL.16.1.A01.1.454.light.4.raw

SEQ ID NO: 600442 - DNA, 523 bp, Homo sapiens
  misc_feature: HIJSMM301CJF1E.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccggacgtcgtccgaacggaccgaacggtaggaagtacgtaaacgaaacgtagtggtcgtcgcgaccaactcttgtcttctacttccttcccgtccc

SEQ ID NO: 600443 - DNA, 460 bp, Homo sapiens; identical to SEQ ID NO: 536053
  misc_feature: HIJSMM301A7BOT.22.28.C06.1.454.light.4.raw

SEQ ID NO: 600444 - DNA, 491 bp, Homo sapiens
  misc_feature: HIJSMM301AL0CL.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgcctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacaggagttcactctcaccatcagcagcctgcagtctgaagattttgcagtttattactgtcagcagtataataactggttcctgctcacgtttcggcgggggaccaaggtggagatcaaacgactgtgctgcaccatct

SEQ ID NO: 600445 - DNA, 500 bp, Homo sapiens
  misc_feature: HIJSMM301AQ97X.15.83.H06.1.454.light.4.raw
tctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgcaaagtgggccccatcaaggttcagtggcagtggctctgggacagatttcactctcaccatcagcagtctccaacctgaagattttgcaacttactactgtcaacagagtttcagtagtccccggacgttcggccgaacggaccgaaggtaggacgatacaaacgaactacgtggcgtgcaccactctgtcttt

SEQ ID NO: 600446 - DNA, 487 bp, Homo sapiens
  misc_feature: HIJSMM301AU6N3.4.36.D03.1.454.light.4.raw
agcactgtagcacgaccggtgctcgatttagctgcgtcacgatctctcttgggggtcagactcagtcaggacacagcatggacttgagggtccccgctcagctcctggggctcctgctgctctggctcccaggtgccaaatgtgacatccagatgacccagtctccttccaccctgtctgcatctgtgggggacagagtcaccatcacttgccgggccagtcagagtgttgataactggttggcctggtatcagcagaaaccagggaaagcccctaaactcctgatttatgatgcctccggtttggaaagtggggtcccatcaaggttcagcggcagtggatctgggacagaattcactctcaccatcagcagcctgcagcctgatgattttgcaacttattactgccaacagtattatagttattctttgacgttcggccaagggaccaaggtggaaatacaaacgaactagtggctgcaccatct

SEQ ID NO: 600447 - DNA, 514 bp, Homo sapiens
  misc_feature: HIJSMM301EEQFG.9.20.B09.1.454.light.4.raw
  modified_base (419)..(419): a, c, t, g, unknown or other
  modified_base (445)..(445): a, c, t, g, unknown or other
  modified_base (460)..(460): a, c, t, g, unknown or other
  modified_base (481)..(481): a, c, t, g, unknown or other
  modified_base (498)..(498): a, c, t, g, unknown or other
tgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccgggcccctgtggtggtcgtctatgataacagtgaccggccctcgtcgatccctgagcgcttctctggctccaactctgggaacacggccaccctgaccatcagcagggccgaagccggggatgaggccgactattactgccaggtgtggcatattatnacccccgtgttcggcgggggacgaanctgacgtccagtcgnccaaggctgccccctccggtnacctctgttcccgcccncctcagacggtatcac

SEQ ID NO: 600448 - DNA, 490 bp, Homo sapiens
  misc_feature: HIJSMM301B43I8.49.67.G01.1.454.light.4.raw
agtcgagagacacgaccggtgctcgatttagagtatacatattgggtttggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagtcaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccagggaccaagctggaaatcagacgaactgtggctgcaccat

SEQ ID NO: 600449 - DNA, 504 bp, Homo sapiens; identical to SEQ ID NO: 535561
  misc_feature: HIJSMM301CXENU.4.57.F02.1.454.light.4.raw

SEQ ID NO: 600450 - DNA, 474 bp, Homo sapiens; identical to SEQ ID NO: 548202
  misc_feature: HIJSMM301DT08A.3.1.A01.1.454.light.4.raw

SEQ ID NO: 600451 - DNA, 503 bp, Homo sapiens; identical to SEQ ID NO: 568855
  misc_feature: HIJSMM301C3P0M.9.71.G05.1.454.light.4.raw

SEQ ID NO: 600452 - DNA, 489 bp, Homo sapiens; identical to SEQ ID NO: 540247
  misc_feature: HIJSMM301DRW64.48.75.G09.1.454.light.4.raw

SEQ ID NO: 600453 - DNA, 493 bp, Homo sapiens
  misc_feature: HIJSMM301AVDVY.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctttcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttcccg

SEQ ID NO: 600454 - DNA, 500 bp, Homo sapiens
  misc_feature: HIJSMM301BJM8Z.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtctaggtcagccaaggctgccccctc

SEQ ID NO: 600455 - DNA, 510 bp, Homo sapiens; identical to SEQ ID NO: 542037
  misc_feature: HIJSMM301BU3A0.4.57.F02.1.454.light.4.raw

SEQ ID NO: 600456 - DNA, 504 bp, Homo sapiens; identical to SEQ ID NO: 540689
  misc_feature: HIJSMM301DLKER.21.38.D05.1.454.light.4.raw

SEQ ID NO: 600457 - DNA, 504 bp, Homo sapiens; identical to SEQ ID NO: 568334
  misc_feature: HIJSMM301CK0QS.12.48.E04.1.454.light.4.raw

SEQ ID NO: 600458 - DNA, 520 bp, Homo sapiens; identical to SEQ ID NO: 539176
  misc_feature: HIJSMM301DJLZZ.27.23.C01.1.454.light.4.raw

SEQ ID NO: 600459 - DNA, 483 bp, Homo sapiens; identical to SEQ ID NO: 547838
  misc_feature: HIJSMM301EZ6HU.46.26.C04.1.454.light.4.raw

SEQ ID NO: 600460 - DNA, 473 bp, Homo sapiens
  misc_feature: HIJSMM301CXFX0.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtgggtccatcaaggttcagtggcagtggatctgggacagatttcactctcaccatcaacagtctgcaacctgaagattttgcaacttactactgtcaacagagtttcactacccctctcactttcggcgggggaccaaggtggaggatcaaacgaactgtgg

SEQ ID NO: 600461 - DNA, 495 bp, Homo sapiens
  misc_feature: HIJSMM301DHA8W.19.83.H06.1.454.light.4.raw
tactctcgtgcacgaccggtgctcgatttagatcacgtgcgtcgcgggcgtagactttgtgtttctcgtagtctgctttgctcagcgtcggggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactgaaaatcaaacagagtggaggctgaggatgttggggtttattactgcatgcaagctctacaaactccctcaacgttcggcggagggaccaaggtggagatcaaacgaactgtggctgcaccatctgtcttcatt

SEQ ID NO: 600462 - DNA, 495 bp, Homo sapiens
  misc_feature: HIJSMM301EH3HE.5.48.E04.1.454.light.4.raw
atcagacacgcacgaccggtgctcgatttagagagcgtcacagagagaaggggctggagaagagctgctcagttaggacccagagggaaccatggaaaccccagcgcagcttctcttcctcctgctactctggctcccagattctgccggagaagttgtcttgacgcagtctccaggcaccctgtctttgtctccaggtgaaagcgccaccctctcctgccgggccagtgagagtcttagcggcgactacttagcctggtatcagcaaaaacctggccagtctcccaggctcctcatctctggtgtttccttcagggccactggcgtcccaggcagattcaggggcagtgggtctgggacagacttcactctcaccatcagcagactggagcctgaagactttgcgctgtatttctgtcagcagtatgttttcgcacctttcactttcggcggtagggaccaaggtggagagcagacgaactgtggctgcaccta

SEQ ID NO: 600463 - DNA, 508 bp, Homo sapiens; identical to SEQ ID NO: 541908
  misc_feature: HIJSMM301CP0PY.47.85.H08.1.454.light.4.raw

SEQ ID NO: 600464 - DNA, 349 bp, Homo sapiens; identical to SEQ ID NO: 560985
  misc_feature: HIJSMM301AULNM.19.86.H09.1.454.light.4.raw

SEQ ID NO: 600465 - DNA, 496 bp, Homo sapiens; identical to SEQ ID NO: 551255
  misc_feature: HIJSMM301AUSU8.10.33.C11.1.454.light.4.raw

SEQ ID NO: 600466 - DNA, 513 bp, Homo sapiens; identical to SEQ ID NO: 559106
  misc_feature: HIJSMM301B6VS3.11.57.F02.1.454.light.4.raw

SEQ ID NO: 600467 - DNA, 478 bp, Homo sapiens
  misc_feature: HIJSMM301CFGL3.40.59.F04.1.454.light.4.raw
tctagcgactcacgaccggtgctcgatttagtacacacacttagggattggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgacgtcctaagtcagcccaac

SEQ ID NO: 600468 - DNA, 477 bp, Homo sapiens
  misc_feature: HIJSMM301DZSGX.8.12.B01.1.454.light.4.raw
ctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggcctcagggatccctgagcgattctctggctccaactctgggaacacagccactctgaccatcagcgggacccaggctacggatgaggctgactattactgtcaggcgtggacagcagcacctatgttggtttcggcggaggaccgaagctgaccgtcctggtcagccaggctcg

SEQ ID NO: 600469 - DNA, 485 bp, Homo sapiens; identical to SEQ ID NO: 541539
  misc_feature: HIJSMM301DZA4J.3.10.A10.1.454.light.4.raw

SEQ ID NO: 600470 - DNA, 494 bp, Homo sapiens
  misc_feature: HIJSMM301AQUA0.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcacacgtgggacatgggcactgcgatcttcggcggagggaccaagctgaccgtcctgggtcagcccaaggctgccccctggtcactc

SEQ ID NO: 600471 - DNA, 484 bp, Homo sapiens; identical to SEQ ID NO: 535240
  misc_feature: HIJSMM301DE06M.47.60.F05.1.454.light.4.raw

SEQ ID NO: 600472 - DNA, 493 bp, Homo sapiens; identical to SEQ ID NO: 535084
  misc_feature: HIJSMM301EWAU2.47.64.F09.1.454.light.4.raw

SEQ ID NO: 600473 - DNA, 515 bp, Homo sapiens
  misc_feature: HIJSMM301EMH6M.13.4.A04.1.454.light.4.raw
tcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggagcagccgatccagcctgcggagcctgtggggcaggtcagcccaaggccaaccccactcgtcactctgttccccg

SEQ ID NO: 600474 - DNA, 487 bp, Homo sapiens; identical to SEQ ID NO: 537208
  misc_feature: HIJSMM301BQ5PD.3.55.E11.1.454.light.4.raw

SEQ ID NO: 600475 - DNA, 505 bp, Homo sapiens; identical to SEQ ID NO: 535503
  misc_feature: HIJSMM301EU1KM.8.28.C06.1.454.light.4.raw

SEQ ID NO: 600476 - DNA, 504 bp, Homo sapiens; identical to SEQ ID NO: 554472
  misc_feature: HIJSMM301DAHPQ.8.28.C06.1.454.light.4.raw

SEQ ID NO: 600477 - DNA, 493 bp, Homo sapiens; identical to SEQ ID NO: 546638
  misc_feature: HIJSMM301DZQI0.13.11.A11.1.454.light.4.raw

SEQ ID NO: 600478 - DNA, 486 bp, Homo sapiens
  misc_feature: HIJSMM301CVA51.19.71.G05.1.454.light.4.raw
  modified_base (429)..(429): a, c, t, g, unknown or other
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaanaactattattatacttcgtggacgttcggccaaggaccaaggtggatatcagacgaa

SEQ ID NO: 600479 - DNA, 496 bp, Homo sapiens; identical to SEQ ID NO: 573952
  misc_feature: HIJSMM301DPRHZ.16.78.H01.1.454.light.4.raw

SEQ ID NO: 600480 - DNA, 491 bp, Homo sapiens
  misc_feature: HIJSMM301COC6X.48.27.C05.1.454.light.4.raw
agtatacatacacgaccggtgctcgatttagacgcgatcgaagggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgccccctc

SEQ ID NO: 600481 - DNA, 441 bp, Homo sapiens; identical to SEQ ID NO: 535074
  misc_feature: HIJSMM301CLH5E.11.3.A03.1.454.light.4.raw

SEQ ID NO: 600482 - DNA, 486 bp, Homo sapiens; identical to SEQ ID NO: 537310
  misc_feature: HIJSMM301EG7PT.15.28.C06.1.454.light.4.raw

SEQ ID NO: 600483 - DNA, 491 bp, Homo sapiens; identical to SEQ ID NO: 550287
  misc_feature: HIJSMM301EV85L.14.36.D03.1.454.light.4.raw

SEQ ID NO: 600484 - DNA, 487 bp, Homo sapiens
  misc_feature: HIJSMM301EM0G0.17.35.D02.1.454.light.4.raw
cgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaagaactgtggctgcaccatctgtctt

SEQ ID NO: 600485 - DNA, 489 bp, Homo sapiens
  misc_feature: HIJSMM301BE0ME.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatcgtagggcagatttcactctcaccatcaatcacctgcaggctgaggtattttgctaacttactactgtcagcaggctaacaggctcgccccccaaccttcggccaggggacacgactggagattaaacgaactgtgctgcacatctgtt

SEQ ID NO: 600486 - DNA, 489 bp, Homo sapiens; identical to SEQ ID NO: 536013
  misc_feature: HIJSMM301D354X.26.23.C01.1.454.light.4.raw

SEQ ID NO: 600487 - DNA, 485 bp, Homo sapiens
  misc_feature: HIJSMM301A1PTV.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcgtcactctgttcccgccctcctccgctacgtaga

SEQ ID NO: 600488 - DNA, 496 bp, Homo sapiens
  misc_feature: HIJSMM301B3P8F.40.73.G07.1.454.light.4.raw
tctagcgactcacgaccggtgctcgatttagctctacgctcagggggctgctcagttaggacccagagggaaccatggaaaccccagcgcaacttctcttcctcctgctactctggctcccagaaaccaccggagaaatagtgttgaagcagtctccagacaccctgtctttgtctccaggggagagagccaccctctcctgcagggccagtcagagtgttagcagcaactccattgcctggtaccagcagaaacctggccagtctcccaggctcctcatctatggtgcttcgaccaggctcaccggcatccctgacaggttcactgccagtgggtctgggacagacttcactctcatcatcaccagactagaacctgaggattttgcagtgtattttgtcaacaacatgataagtcaccgttcagctttggccggggacccaggtggagatcagacgaactgtggctgcaccatctgtcttcatcttcccgccta

SEQ ID NO: 600489 - DNA, 454 bp, Homo sapiens; identical to SEQ ID NO: 535005
  misc_feature: HIJSMM301DSWWF.19.86.H09.1.454.light.4.raw

SEQ ID NO: 600490 - DNA, 447 bp, Homo sapiens
  misc_feature: HIJSMM301CHW26.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacaatggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccctcctccatactcgta

SEQ ID NO: 600491 - DNA, 488 bp, Homo sapiens; identical to SEQ ID NO: 571029
  misc_feature: HIJSMM301EUNHP.14.53.E09.1.454.light.4.raw

SEQ ID NO: 600492 - DNA, 466 bp, Homo sapiens
  misc_feature: HIJSMM301DN86Q.11.25.C03.1.454.light.4.raw
cgagagataccacgaccggtgctcgatttagtagtgtagatttgggtttggggctgggcctcaggaagcagcatcggaggtgcctcagccatggcatggatccctctcttcctcggcgtccttccttactgcacaggattcgtggcctccgatgagttgactcagccaccctcagtgtccgtgtccccaggacagacagccagaatcccctgctctggaattgaattgagagataaatatacttgttggtatcaacagaagccaggccagtcccctgtattggtcatctatcaagatgtgaagcggccctcagggatccctgagcgattctctggctccaactctgggaacgcagccactctgaccatcagcgggacccaggctatggatgaggctgactatattgtcaggcgtgggacagcagcactgcccgttatgtcttcggaactgggaccaaggtcaccgt

SEQ ID NO: 600493 - DNA, 508 bp, Homo sapiens; identical to SEQ ID NO: 554680
  misc_feature: HIJSMM301CRJ3B.47.85.H08.1.454.light.4.raw

SEQ ID NO: 600494 - DNA, 485 bp, Homo sapiens; identical to SEQ ID NO: 535688
  misc_feature: HIJSMM301DHBNA.19.5.A05.1.454.light.4.raw

SEQ ID NO: 600495 - DNA, 447 bp, Homo sapiens
  misc_feature: HIJSMM301DYRW6.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctcgttcccaccctccccatactcgta

SEQ ID NO: 600496 - DNA, 477 bp, Homo sapiens
  misc_feature: HIJSMM301ANJDI.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaacgtcagaccccg

SEQ ID NO: 600497 - DNA, 500 bp, Homo sapiens
  misc_feature: HIJSMM301EQWLT.19.67.G01.1.454.light.4.raw
tactctcgtgcacgaccggtgctcgatttagagtatacatattgggtttgggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatcttttgcacccacaacagtggcaacattgccagcaattttgtgcagtggtaccagcagcgcccgggcagttcccccaccattgtgatctatgaggataatcaaagaccgtctggggtccctgatcggttctctggctccatcgacagctcctccaactctgcctccctcaccatctctggactgaagactgaggacgaggctgactactactgtcagtcttatgatagccgcggtcatgtggtcttcggcggagggaccaagctgaccgtctaggtcagcccaaggctgccccctc

SEQ ID NO: 600498 - DNA, 487 bp, Homo sapiens; identical to SEQ ID NO: 536536
  misc_feature: HIJSMM301D1M22.26.45.E01.1.454.light.4.raw

SEQ ID NO: 600499 - DNA, 499 bp, Homo sapiens
  misc_feature: HIJSMM301BBVKV.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtctagcagtataataactggcctccacggtacacttttggccagggggaccaagctggagatcaaacgaactgtggctgcaccatctgtt

SEQ ID NO: 600500 - DNA, 504 bp, Homo sapiens; identical to SEQ ID NO: 535561
  misc_feature: HIJSMM301B152S.4.57.F02.1.454.light.4.raw

SEQ ID NO: 600501 - DNA, 473 bp, Homo sapiens; identical to SEQ ID NO: 546369
  misc_feature: HIJSMM301AIXGP.18.76.G10.1.454.light.4.raw

SEQ ID NO: 600502 - DNA, 485 bp, Homo sapiens; identical to SEQ ID NO: 536075
  misc_feature: HIJSMM301A5W15.17.21.B10.1.454.light.4.raw

SEQ ID NO: 600503 - DNA, 471 bp, Homo sapiens
  misc_feature: HIJSMM301D5OIX.3.82.H05.1.454.light.4.raw
agacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaagcccctgagttcctgatgtctgctgcatccaccctgcaaagtggagtcccatccagattcagcgtcagtgaatctgggacagagttcactctcaccatcagcagcctgcagcctgaagattttgctaacttactattgtcaacaggctgacagtctcccgctcactttcggcggagggaccaaggtggagatcaaacgaactgtg

SEQ ID NO: 600504 - DNA, 490 bp, Homo sapiens; identical to SEQ ID NO: 538714
  misc_feature: HIJSMM301EFLZW.11.12.B01.1.454.light.4.raw

SEQ ID NO: 600505 - DNA, 494 bp, Homo sapiens
  misc_feature: HIJSMM301B27MQ.41.18.B07.1.454.light.4.raw
tctatactatcacgaccggtgctcgatttagtcgctgcgtaagggggggaggctagctgtggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttcgtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaagctgaccgtctaggtcagcccaaggctcg

SEQ ID NO: 600506 - DNA, 490 bp, Homo sapiens
  misc_feature: HIJSMM301C3ZV9.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaagagccacactctcctgcagggccagtcagagtgttagcagcagcttagcctggtaccagcagaaacctggccaggcctcccaggcctcctcatctatggtgcatctacgagggccactggtatcccagccaggttcagtggcaggtgggtctgggacaggagttcactctcaccatcagcagcctgcagtctgaagtattttgctagtttattactgtcagcactataataactcggcctccgtactagttttggccgaggggaccaagctggagatcaaacgaa

SEQ ID NO: 600507 - DNA, 447 bp, Homo sapiens; identical to SEQ ID NO: 535201
  misc_feature: HIJSMM301DEV5C.18.9.A09.1.454.light.4.raw

SEQ ID NO: 600508 - DNA, 460 bp, Homo sapiens; identical to SEQ ID NO: 539553
  misc_feature: HIJSMM301AHWS0.11.86.H09.1.454.light.4.raw

SEQ ID NO: 600509 - DNA, 500 bp, Homo sapiens; identical to SEQ ID NO: 576893
  misc_feature: HIJSMM301D3CHJ.43.34.D01.1.454.light.4.raw

SEQ ID NO: 600510 - DNA, 518 bp, Homo sapiens; identical to SEQ ID NO: 539372
  misc_feature: HIJSMM301EC67M.7.86.H09.1.454.light.4.raw

SEQ ID NO: 600511 - DNA, 514 bp, Homo sapiens
  misc_feature: HIJSMM301EM3N8.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcacccatctctggactgaagactgaggacgaggctgactactactgtcagtcttatgataacaccagggtgtgttcggcggagggaccaagctggccgtcctaggtcagcccaaggctgccccctcggtcactctgttcccaccctcctcgagtagtaca

SEQ ID NO: 600512 - DNA, 494 bp, Homo sapiens; identical to SEQ ID NO: 534992
  misc_feature: HIJSMM301A201N.9.1.A01.1.454.light.4.raw

SEQ ID NO: 600513 - DNA, 500 bp, Homo sapiens; identical to SEQ ID NO: 556258
  misc_feature: HIJSMM301AOWE0.40.42.D09.1.454.light.4.raw

SEQ ID NO: 600514 - DNA, 502 bp, Homo sapiens; identical to SEQ ID NO: 556202
  misc_feature: HIJSMM301A7JVY.41.18.B07.1.454.light.4.raw

SEQ ID NO: 600515 - DNA, 505 bp, Homo sapiens
  misc_feature: HIJSMM301DJ7NJ.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccacgtttcggccctgggaccaaagtggatatcaaacgaactgtggctgcaccatctgtt

SEQ ID NO: 600516 - DNA, 498 bp, Homo sapiens
  misc_feature: HIJSMM301B1Q52.3.33.C11.1.454.light.4.raw
agacgcactccacgaccggtgctcgatttagagtgagctcgttggggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagccaaggctgccccctcggtccactctcgttcccaccctcctcgagtgcgtct

SEQ ID NO: 600517 - DNA, 448 bp, Homo sapiens; identical to SEQ ID NO: 540018
  misc_feature: HIJSMM301AKW9V.18.9.A09.1.454.light.4.raw

SEQ ID NO: 600518 - DNA, 495 bp, Homo sapiens
  misc_feature: HIJSMM301D0AYU.4.72.G06.1.454.light.4.raw
agcactgtagcacgaccggtgctcgatttagctacgactgcaagggaaagggggaggaactgctcagttaggacccagacggaaccatggaagccccagcgcagcttctcttcctcctgctactctggctcccagaaagcagtggagaagtagtgatgacgcagtctccagccaccctgcctgtgtctccaggggacactgccaccctctcctgcagggccagtcagagtgttggcactaatttagcctggtaccagcagaaacctggccaagctcccaggctgctcatctataatacaatcacaagggacattggtgtcccagacaggttcagcggcagtgggtctgggacagagttcactctcactatcagcagcctgcactttgaagattttgcagtctatcattgtcagcagtataattggtggcctcggacgttcggtccgaacggaccgaacggtaggaaagtacaaacgaactagtggcgtgcaccat

SEQ ID NO: 600519 - DNA, 485 bp, Homo sapiens; identical to SEQ ID NO: 593029
  misc_feature: HIJSMM301EN0MC.3.10.A10.1.454.light.4.raw

SEQ ID NO: 600520 - DNA, 504 bp, Homo sapiens; identical to SEQ ID NO: 540689
  misc_feature: HIJSMM301EW0XU.21.38.D05.1.454.light.4.raw

SEQ ID NO: 600521 - DNA, 488 bp, Homo sapiens; identical to SEQ ID NO: 536554
  misc_feature: HIJSMM301DNCOW.26.37.D04.1.454.light.4.raw

SEQ ID NO: 600522 - DNA, 502 bp, Homo sapiens
  misc_feature: HIJSMM301DV38H.40.46.E02.1.454.light.4.raw
  modified_base (236)..(236): a, c, t, g, unknown or other
tctagcgactcacgaccggtgctcgatttagactcatctacagggaaagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagaagcattgccaaaaaaatntgcttattggtaccaacagaagtcaggccaggcccctgtgctggtcatctatgaggacaacaaacgaccctccgagatccctgagagattctctggctccagctcagggacaatggccaccttggctctcagtgggcccaggtggaggatgaagctgactactactgttactcagtggacagcagtggaaatcaatggggtattcggcggagggaccaagctgaccgtcctaggtcagcccaaggctgccccctcggtcactctcg

SEQ ID NO: 600523 - DNA, 484 bp, Homo sapiens
  misc_feature: HIJSMM301BA9QL.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtgagatacaaacgaa

SEQ ID NO: 600524 - DNA, 447 bp, Homo sapiens; identical to SEQ ID NO: 535020
  misc_feature: HIJSMM301AJQ1Y.18.9.A09.1.454.light.4.raw

SEQ ID NO: 600525 - DNA, 494 bp, Homo sapiens; identical to SEQ ID NO: 535276
  misc_feature: HIJSMM301DM78F.16.6.A06.1.454.light.4.raw

SEQ ID NO: 600526 - DNA, 447 bp, Homo sapiens; identical to SEQ ID NO: 535201
  misc_feature: HIJSMM301CTYYU.18.9.A09.1.454.light.4.raw

SEQ ID NO: 600527 - DNA, 476 bp, Homo sapiens; identical to SEQ ID NO: 537812
  misc_feature: HIJSMM301BJ1MS.3.82.H05.1.454.light.4.raw

SEQ ID NO: 600528 - DNA, 484 bp, Homo sapiens
  misc_feature: HIJSMM301C01BD.4.71.G05.1.454.light.4.raw
agcactgtagcacgaccggtgctcgatttagtgtcgtcgcaagagagaggggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccgccatcagctgcaagtccagccagagtgttttatcagctccaacaataagaactacttagcttggtaccagcagaaaccaggacagcctcctaacctgctcatttactgggcatctacccgggaatccggggtccctgaccgattcagtggcagcgggtctgggacagatttcactctcaccatcaacagcctgcaggctgaagatgtggcagtttattactgtcagcagtattatataactcccttcactttcggcggagggaccaaggtggaggatcaaacgaa

SEQ ID NO: 600529 - DNA, 487 bp, Homo sapiens
  misc_feature: HIJSMM301C60I0.48.54.E10.1.454.light.4.raw
agtatacatacacgaccggtgctcgatttagatcgtagcagaacacacaaaggggctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatttcctgcactgggaccagctccaacatcggcgtaggttatgatgtacactggtaccagcaacttccaggaacagtccccagactcctcatctatgataacaacaatcggccctcaggggtccctgaccggttctctggctccaagtctggcacctcagcctccctggccatcactgggctccagactgaggatgaggctgattatactgccagtcctatgacagcaacctgagcggttgggtgttcggcggagggaccagggtgaccc

SEQ ID NO: 600530 - DNA, 482 bp, Homo sapiens; identical to SEQ ID NO: 535920
  misc_feature: HIJSMM301C4GM1.19.71.G05.1.454.light.4.raw

SEQ ID NO: 600531 - DNA, 486 bp, Homo sapiens
  misc_feature: HIJSMM301BUJ8W.49.67.G01.1.454.light.4.raw
agtcgagagacacgaccggtgctcgatttagagtatacatattgggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctccactttcggcggagggaccagggtggagatcaaaacg

SEQ ID NO: 600532 - DNA, 502 bp, Homo sapiens
  misc_feature: HIJSMM301CN4X2.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtctgcgtcagcccaaggctcgccccctcggtcactc

SEQ ID NO: 600533 - DNA, 484 bp, Homo sapiens; identical to SEQ ID NO: 535400
  misc_feature: HIJSMM301BHKP9.46.26.C04.1.454.light.4.raw

SEQ ID NO: 600534 - DNA, 445 bp, Homo sapiens; identical to SEQ ID NO: 546083
  misc_feature: HIJSMM301C1J9G.5.9.A09.1.454.light.4.raw

SEQ ID NO: 600535 - DNA, 501 bp, Homo sapiens; identical to SEQ ID NO: 535746
  misc_feature: HIJSMM301D7Y4L.18.11.A11.1.454.light.4.raw

SEQ ID NO: 600536 - DNA, 496 bp, Homo sapiens
  misc_feature: HIJSMM301ARL4O.12.38.D05.1.454.light.4.raw
atacgacgtacacgaccggtgctcgatttagtatctgatagttgggtttgggggaactgctcagttaggacccagacggaaccatggaagccccagcgcagcttctcttcctcctgctactctggctcccagattcctctggagaagttgtgatgacgcagtctccagccaccctgtctgcgtctccaggggaaagagtcaccctctcatgcagggccagtgagattgttaccaccaacttagcctggtaccaacagaaacctggccagcctcccaggctcctcatttatggtgcatccacaagggccgctggtgtcccagccaggttcagtggcagtggatctgcgacagagttcactctcaccgtcagcagcctgcagtctgaagattttgctagtttattactgtcagcagtatgagaagtggttcaagactttcggcggagggaccgaaggtggaggatacaaacgaactagtggctgcaccatctgtcttc

SEQ ID NO: 600537 - DNA, 505 bp, Homo sapiens; identical to SEQ ID NO: 552248
  misc_feature: HIJSMM301EOMKJ.11.67.G01.1.454.light.4.raw

SEQ ID NO: 600538 - DNA, 494 bp, Homo sapiens; identical to SEQ ID NO: 534992
  misc_feature: HIJSMM301D0QSJ.9.1.A01.1.454.light.4.raw

SEQ ID NO: 600539 - DNA, 416 bp, Homo sapiens; identical to SEQ ID NO: 545902
  misc_feature: HIJSMM301BUKRW.18.78.H01.1.454.light.4.raw

SEQ ID NO: 600540 - DNA, 523 bp, Homo sapiens
  misc_feature: HIJSMM301AP3DW.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtcgaacggaccgaacggtaggaaggtacgaacgaaactacgtggtcgtggcaccactctcgtcgttctactcttcccgtccctact

SEQ ID NO: 600541 - DNA, 504 bp, Homo sapiens; identical to SEQ ID NO: 538940
  misc_feature: HIJSMM301AIY8D.2.35.D02.1.454.light.4.raw

SEQ ID NO: 600542 - DNA, 495 bp, Homo sapiens
  misc_feature: HIJSMM301CTCO0.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgcccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtacacttttggcctaggggacccaggtggagatcagacgaactgtggctgcaccatctgtcttcatcttcccg

SEQ ID NO: 600543 - DNA, 494 bp, Homo sapiens
  misc_feature: HIJSMM301CMD58.52.83.H06.1.454.light.4.raw
cgcagtacgacacgaccggtgctcgatttagatcacgtgcgtcgcgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaattatttaaattggtatcagcagaaaccagggaaagcccctaaactcctgatctacgatgcatccaatttggaaacaggggtcccatcaaggttcagtggaagtggttctgggacacattttactttctaccatcagcggcctgcagcctgaagatattgcaacatattactgtcaacagtatggtaatacttcccactcactttcgtcggagggacgaaggtacgagatcaaacgaacctagtggctgcaccatctgtcttt

SEQ ID NO: 600544 - DNA, 489 bp, Homo sapiens; identical to SEQ ID NO: 585781
  misc_feature: HIJSMM301BA5PP.26.23.C01.1.454.light.4.raw

SEQ ID NO: 600545 - DNA, 487 bp, Homo sapiens
  misc_feature: HIJSMM301ELVV2.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggccagggaccaaactggacatacaaacgaactgtggctgcaccatctgt

SEQ ID NO: 600546 - DNA, 488 bp, Homo sapiens
  misc_feature: HIJSMM301A1S0D.5.6.A06.1.454.light.4.raw
atcagacacgcacgaccggtgctcgatttagatctactgacagggggcaggagtcagacccagtcaggacacagcatggacatgagggtccccgctcagctcctggggctcctgctgctctggttcccaggttccagatgcgacatccagatgacccagtctccatcttccgtgtctgcttctataggagacagagtcaccatcacttgtcgggcgagtcagggtcttaacaactacttagcctggtatcagcagaagccagggaaagcccctaagctcctgatctatgctacatccagtttgcaaagtggggtcccttcaaggttcagcggcagtggaactggtatagatttcactctcaccatcaccagcctgcagcctgaagatcttgcaacttactattgtcagcaggctaggaggacgccgtggacgttcggccaagggaccaaggtggaaatcaaacgaaacctgtggctgcaccatctgtt

SEQ ID NO: 600547 - DNA, 484 bp, Homo sapiens; identical to SEQ ID NO: 535400
  misc_feature: HIJSMM301B94L4.46.26.C04.1.454.light.4.raw

SEQ ID NO: 600548 - DNA, 435 bp, Homo sapiens
  misc_feature: HIJSMM301ECUGB.18.5.A05.1.454.light.4.raw
  modified_base (427)..(427): a, c, t, g, unknown or other
tacgagtatgcacgaccggtgctcgatttagatagatagacaggggtgggaaggagactgggacatccagatgacccagtctccttccaccctgtctgcatctgtaggagacagagtcaccatctcttgccgggccactcagagtattagtatctggttggcctggtatcagcagaaaccagggaaagcccctaagctcctgatcgagaaggcgtctagtttagaaagtggggtcccatcaaggtttagcggcagtggatctgggacagaattcactctcaccatcagcagcctgcagcctgatgattttgcaacttattactgccaacattataatacttattcgtacacttttggccaggggaccaagctggagatcaaacgaactgtggctgcaccatctgtcttcatcttcccgcatctgacntactcgta

SEQ ID NO: 600549 - DNA, 486 bp, Homo sapiens
  misc_feature: HIJSMM301A0NGP.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaaggacaaccca

SEQ ID NO: 600550 - DNA, 499 bp, Homo sapiens
  misc_feature: HIJSMM301ADFSC.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacgacgactggagattaaaggaacgtagtggctgcaccactctgtcttctatcttccccg

SEQ ID NO: 600551 - DNA, 487 bp, Homo sapiens
  misc_feature: HIJSMM301BO98O.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggacttcgtcggagggaccgaaggtaggagatcaaacgaa

SEQ ID NO: 600552 - DNA, 495 bp, Homo sapiens; identical to SEQ ID NO: 555261
  misc_feature: HIJSMM301A51J5.51.71.G05.1.454.light.4.raw

SEQ ID NO: 600553 - DNA, 483 bp, Homo sapiens; identical to SEQ ID NO: 535317
  misc_feature: HIJSMM301CSTGM.4.1.A01.1.454.light.4.raw

SEQ ID NO: 600554 - DNA, 505 bp, Homo sapiens
  misc_feature: HIJSMM301D4JMP.3.79.H02.1.454.light.4.raw
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggtatttggtggagggaccaagctgaccgtctaggtcagcccaaggctgccccctcggt

SEQ ID NO: 600555 - DNA, 447 bp, Homo sapiens; identical to SEQ ID NO: 535020
  misc_feature: HIJSMM301A8ONV.18.9.A09.1.454.light.4.raw

SEQ ID NO: 600556 - DNA, 499 bp, Homo sapiens
  misc_feature: HIJSMM301CTDUD.11.59.F04.1.454.light.4.raw
cgagagataccacgaccggtgctcgatttagtacacacacttagggattggggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtcctaggtcagcccaaggcccaacccatgtcactctcgttcccacctcctcgtatctctcg

SEQ ID NO: 600557 - DNA, 502 bp, Homo sapiens
  misc_feature: HIJSMM301BSK1I.21.81.H04.1.454.light.4.raw
  modified_base (337)..(337): a, c, t, g, unknown or other
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttcnctggctccaagtctggcaacacggcctccctgaccatctctgggctccaggctgatgacgaggctgattattactgcaggtcatatacaatcagcaacacttatgtcttcgggactgggaccaagatcaccgtcctaggtcagcccaaggccaaccccactgtca

SEQ ID NO: 600558 - DNA, 504 bp, Homo sapiens; identical to SEQ ID NO: 539083
  misc_feature: HIJSMM301D1Q7D.8.19.B08.1.454.light.4.raw

SEQ ID NO: 600559 - DNA, 488 bp, Homo sapiens; identical to SEQ ID NO: 536554
  misc_feature: HIJSMM301DT59L.26.37.D04.1.454.light.4.raw

SEQ ID NO: 600560 - DNA, 441 bp, Homo sapiens; identical to SEQ ID NO: 545199
  misc_feature: HIJSMM301EDF3L.18.9.A09.1.454.light.4.raw

SEQ ID NO: 600561 - DNA, 481 bp, Homo sapiens
  misc_feature: HIJSMM301EMF5G.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagattttgcaacttactattgtcaacaggctaacagtttcccgctcaccttcggcggggggaccgaaggtggaggatcaaacgaactgtggctgcacc

SEQ ID NO: 600562 - DNA, 383 bp, Homo sapiens; identical to SEQ ID NO: 447524
  misc_feature: HIJSMM301B8CSI.41.26.C04.1.454.light.4.raw

SEQ ID NO: 600563 - DNA, 481 bp, Homo sapiens
  misc_feature: HIJSMM301COQMT.12.10.A10.1.454.light.4.raw
atacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaaagcccctaacgtcctgatctatggtgcatccactttgcatagtggggtcccatcaaggttcagcggcagtggatctgggacagaattcactctcacaatcaccagcctgcagcctgaagattttgcaacttattactgtcaacaggtttatatttaccctcgttattttcggccctgggaccacagtagatatacaaacgaactgtggctgcacc

SEQ ID NO: 600564 - DNA, 487 bp, Homo sapiens; identical to SEQ ID NO: 536206
  misc_feature: HIJSMM301DPKGS.47.38.D05.1.454.light.4.raw

SEQ ID NO: 600565 - DNA, 499 bp, Homo sapiens; identical to SEQ ID NO: 555664
  misc_feature: HIJSMM301CMV5M.40.42.D09.1.454.light.4.raw

SEQ ID NO: 600566 - DNA, 503 bp, Homo sapiens; identical to SEQ ID NO: 535140
  misc_feature: HIJSMM301CUPXT.18.37.D04.1.454.light.4.raw

SEQ ID NO: 600567 - DNA, 491 bp, Homo sapiens
  misc_feature: HIJSMM301APFK9.16.68.G02.1.454.light.4.raw
tgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaactgtggctgcaccatctgtctt

SEQ ID NO: 600568 - DNA, 494 bp, Homo sapiens; identical to SEQ ID NO: 534994
  misc_feature: HIJSMM301AP5VQ.27.78.H01.1.454.light.4.raw

SEQ ID NO: 600569 - DNA, 512 bp, Homo sapiens
  misc_feature: HIJSMM301A4EQ7.40.81.H04.1.454.light.4.raw
tctagcgactcacgaccggtgctcgatttagtagtgtagattcgcggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggcaacaattgggtcttcggcggagggaccaagctgaccgtcctaggtcagcccaaggctgccccctcggtcactctgttcccta

SEQ ID NO: 600570 - DNA, 480 bp, Homo sapiens
  misc_feature: HIJSMM301CVKEM.48.28.C06.1.454.light.4.raw
agtatacatacacgaccggtgctcgatttagagctcacgtattgggtttggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaaggctgaccgtcctaagtcagcccaac

SEQ ID NO: 600571 - DNA, 493 bp, Homo sapiens
  misc_feature: HIJSMM301EDEI1.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattacttgtcagcagcgtagcaactggcctctctactttcggcggagggaccagggtggagatcagacgaactgtggctgcaccatctgtt

SEQ ID NO: 600572 - DNA, 504 bp, Homo sapiens; identical to SEQ ID NO: 590341
  misc_feature: HIJSMM301E1U29.9.53.E09.1.454.light.4.raw

SEQ ID NO: 600573 - DNA, 500 bp, Homo sapiens
  misc_feature: HIJSMM301D2M9V.51.81.H04.1.454.light.4.raw
cgatcgtatacacgaccggtgctcgatttagtagtgtagattcgcgggggggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactctgttccccg

SEQ ID NO: 600574 - DNA, 502 bp, Homo sapiens
  misc_feature: HIJSMM301ALLR2.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcggtcggtacgggaccgaacggacggacggatacagacgaactacgtggcgtgcaccactactgtcttcta

SEQ ID NO: 600575 - DNA, 503 bp, Homo sapiens
  misc_feature: HIJSMM301D6451.51.23.C01.1.454.light.4.raw
cgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaagagccaccctctcctgcagggccagtgagagtattgacatcttcttggcctggtaccaacagaaacctggccaggctccccgactcctcatttatgatgcatccaaaagggtcgttggcatcccagccaggttcagtgacagtgggtctgggacagaattcactctcaccatcaccagactagagcctgaagattttgcagtttattactgtcagcagcgtaacaactggctctctttcggcggagggaccaaggtggagatcaaacgaactgtggctgcaccatctgtcttcatcttcccgccat

SEQ ID NO: 600576 - DNA, 485 bp, Homo sapiens; identical to SEQ ID NO: 536307
  misc_feature: HIJSMM301BOCAM.46.35.D02.1.454.light.4.raw

SEQ ID NO: 600577 - DNA, 494 bp, Homo sapiens
  misc_feature: HIJSMM301EW7R5.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcagggtggaggctgaggatgttggggtttgttcctccatgcaaggtacacactggccttttggccaggggaccaacctcggagatcaaatgaactgtggctgcaccatctgtctt

SEQ ID NO: 600578 - DNA, 508 bp, Homo sapiens
  misc_feature: HIJSMM301CEU1Y.48.37.D04.1.454.light.4.raw
agtatacatacacgaccggtgctcgatttagtagcatactgttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcgagggaccaagctgaccgtctgggtcagccaaggctgccccctcggtcactctgttcccaccct

SEQ ID NO: 600579 - DNA, 484 bp, Homo sapiens
  misc_feature: HIJSMM301DSJIK.4.27.C05.1.454.light.4.raw
agcactgtagcacgaccggtgctcgatttagacgcgatcgaagggtttgggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcgtcctacatagtaatggatacaactatttggattggtacctgcagaagccagggcagtctccacagctcctgatctatttgggttctaaccgggcctccggggtccctgacaggttcagtggcagtggatcaggcacagattttacactgagaatcagcagagtggaggctgaggatgttggggttactactgcatgcaagctctacaagccacctacacttttggccagggaccaggctggagatcaaacgaactgt

SEQ ID NO: 600580 - DNA, 489 bp, Homo sapiens; identical to SEQ ID NO: 535139
  misc_feature: HIJSMM301EIKH8.14.55.E11.1.454.light.4.raw

SEQ ID NO: 600581 - DNA, 484 bp, Homo sapiens; identical to SEQ ID NO: 538870
  misc_feature: HIJSMM301C4S1D.11.76.G10.1.454.light.4.raw

SEQ ID NO: 600582 - DNA, 507 bp, Homo sapiens
  misc_feature: HIJSMM301C4QQC.16.46.E02.1.454.light.4.raw
  modified_base (476)..(476): a, c, t, g, unknown or other
  modified_base (500)..(500): a, c, t, g, unknown or other
tgtactactccacgaccggtgctcgatttagactcatctacagggaaaggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagctatatacagcaacaatatttatgttcgtagtacggacgagacgacgtccgacgtcgngacgacgaccgaacccaaccaccncacctct

SEQ ID NO: 600583 - DNA, 467 bp, Homo sapiens
  misc_feature: HIJSMM301DHLH8.11.70.G04.1.454.light.4.raw
cgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgttgcaacttattactgtcaaaagaatagcgctgccccgctcagtttcggcggagggaccaaggtggagataacg

SEQ ID NO: 600584 - DNA, 484 bp, Homo sapiens; identical to SEQ ID NO: 535400
  misc_feature: HIJSMM301ARFKO.46.26.C04.1.454.light.4.raw

SEQ ID NO: 600585 - DNA, 520 bp, Homo sapiens
  misc_feature: HIJSMM301C93QP.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccgccct

SEQ ID NO: 600586 - DNA, 487 bp, Homo sapiens; identical to SEQ ID NO: 585180
  misc_feature: HIJSMM301B9TOR.19.71.G05.1.454.light.4.raw

SEQ ID NO: 600587 - DNA, 444 bp, Homo sapiens; identical to SEQ ID NO: 535856
  misc_feature: HIJSMM301DE2HO.9.9.A09.1.454.light.4.raw

SEQ ID NO: 600588 - DNA, 477 bp, Homo sapiens
  misc_feature: HIJSMM301BYGMN.49.34.D01.1.454.light.4.raw
agtcgagagacacgaccggtgctcgatttagatcgtctgtgttgggtttgggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcggggggaccgaacggtggagatcaagcgaactgtgg

SEQ ID NO: 600589 - DNA, 509 bp, Homo sapiens
  misc_feature: HIJSMM301AIL7O.4.39.D06.1.454.light.4.raw
  modified_base (159)..(159): a, c, t, g, unknown or other
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtcgggtnccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaaatgtgatattacggcggagggaccaaaactgaccgtcctaggtcagcccaaggctgccccctcc

SEQ ID NO: 600590 - DNA, 497 bp, Homo sapiens; identical to SEQ ID NO: 545786
  misc_feature: HIJSMM301A5UZP.48.59.F04.1.454.light.4.raw

SEQ ID NO: 600591 - DNA, 486 bp, Homo sapiens; identical to SEQ ID NO: 535043
  misc_feature: HIJSMM301EEDD7.46.35.D02.1.454.light.4.raw

SEQ ID NO: 600592 - DNA, 497 bp, Homo sapiens
  misc_feature: HIJSMM301CRPJC.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccaggggaccaagcgtggagatacaaacgaactgtggctgcaccatctgtctt

SEQ ID NO: 600593 - DNA, 501 bp, Homo sapiens; identical to SEQ ID NO: 539550
  misc_feature: HIJSMM301C3SX1.14.57.F02.1.454.light.4.raw

SEQ ID NO: 600594 - DNA, 489 bp, Homo sapiens
  misc_feature: HIJSMM301EV3XI.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatgttggagtttattactgcatgcaagctctacaaactcctctcactttcggcggagggaccaaaggtggagatcaaaacgaactgt

SEQ ID NO: 600595 - DNA, 490 bp, Homo sapiens; identical to SEQ ID NO: 563795
  misc_feature: HIJSMM301EA8TF.14.55.E11.1.454.light.4.raw

SEQ ID NO: 600596 - DNA, 514 bp, Homo sapiens; identical to SEQ ID NO: 546238
  misc_feature: HIJSMM301CZP3N.47.85.H08.1.454.light.4.raw

SEQ ID NO: 600597 - DNA, 496 bp, Homo sapiens
  misc_feature: HIJSMM301EREZ2.51.71.G05.1.454.light.4.raw
cgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactcgtcta

SEQ ID NO: 600598 - DNA, 509 bp, Homo sapiens; identical to SEQ ID NO: 560392
  misc_feature: HIJSMM301DBUSG.5.24.C02.1.454.light.4.raw

SEQ ID NO: 600599 - DNA, 509 bp, Homo sapiens
  misc_feature: HIJSMM301BG5BQ.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgaccatctctgggctccaggctgaggacgaggctgattattactgcaactcacttacaacaccgacacttgcgtattcggcggcgggaccaagctgaccgtcctaggtcagcccaaggctgccccctcggtcactcc

SEQ ID NO: 600600 - DNA, 494 bp, Homo sapiens
  misc_feature: HIJSMM301ATU36.40.37.D04.1.454.light.4.raw
tctagcgactcacgaccggtgctcgatttagtagcatactgttgggtttgggggatcaggacttctcagttcatcttctcaccatgaggctccctgctcagctcctggggctgctaatgctctggatccctggttccagtgcgagggttgtgatgactcagactccactctctctgtccgtcacccctggacagccggcctccatctcctgcaagtctgctcagagcctcctgcatggtgatggaatcacctatttatattggtacctgcagaagccaggccagtctccacagctcctaatctatgaggtttccagccggttctctggagtgccagataggttcagtggcagcgggtcagtgacagatttcacactgaaaatcagccgggtggaggctgaggatgttggggtttattactgcatgcaaggtttataccttcctcggactttcggccctcgggaccgacgagtggagtgtcgtaacgaactacgt

SEQ ID NO: 600601 - DNA, 447 bp, Homo sapiens; identical to SEQ ID NO: 535201
  misc_feature: HIJSMM301D7QXR.18.9.A09.1.454.light.4.raw

SEQ ID NO: 600602 - DNA, 510 bp, Homo sapiens; identical to SEQ ID NO: 535474
  misc_feature: HIJSMM301BYC7N.17.33.C11.1.454.light.4.raw

SEQ ID NO: 600603 - DNA, 485 bp, Homo sapiens; identical to SEQ ID NO: 536040
  misc_feature: HIJSMM301CABHE.15.1.A01.1.454.light.4.raw

SEQ ID NO: 600604 - DNA, 509 bp, Homo sapiens; identical to SEQ ID NO: 539359
  misc_feature: HIJSMM301AF4D3.47.85.H08.1.454.light.4.raw

SEQ ID NO: 600605 - DNA, 498 bp, Homo sapiens
  misc_feature: HIJSMM301BMRO5.52.2.A02.1.454.light.4.raw
cgcagtacgacacgaccggtgctcgatttagactcatctacaggggaggggtgacagccatggaccctggaagggcctgggctagggacagggaccatagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagtgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggccaacccactgtcactctcgttcccgccctcctctatacgatcg

SEQ ID NO: 600606 - DNA, 495 bp, Homo sapiens
  misc_feature: HIJSMM301EO5FP.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaaacactgttttcggcggagggaccaagctgaccgtcctaggtcagcccaaggctgcccctcggtcactctgttcccacctcctcgagtgcgtct

SEQ ID NO: 600607 - DNA, 488 bp, Homo sapiens; identical to SEQ ID NO: 537673
  misc_feature: HIJSMM301CN7RS.12.31.C09.1.454.light.4.raw

SEQ ID NO: 600608 - DNA, 486 bp, Homo sapiens; identical to SEQ ID NO: 535523
  misc_feature: HIJSMM301AYBLV.22.73.G07.1.454.light.4.raw

SEQ ID NO: 600609 - DNA, 496 bp, Homo sapiens
  misc_feature: HIJSMM301CN6A6.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaacgtgattcaccttcggccaagggacacgactggagattaaacgaactgtggctgcaccatctgtctt

SEQ ID NO: 600610 - DNA, 473 bp, Homo sapiens
  misc_feature: HIJSMM301AODI6.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcagcgtgggacagcagcactgccgctatgtcttcggaactgggaccaaggtcaccgtcctaagtcagccccg

SEQ ID NO: 600611 - DNA, 514 bp, Homo sapiens
  misc_feature: HIJSMM301DGYOW.12.71.G05.1.454.light.4.raw
atacgacgtacacgaccggtgctcgatttagtgtcgtcgcaagagagaggggagtgaggagcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaagtgaccgtcctaagtcagcccaaggctgccccctcggtcactctgttcccgccct

SEQ ID NO: 600612 - DNA, 518 bp, Homo sapiens
  misc_feature: HIJSMM301DTSHP.22.30.C08.1.454.light.4.raw
acatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtctaggtcagcccaaggctgccccctcggtcactctgttcccacctcctcacgtcg

SEQ ID NO: 600613 - DNA, 486 bp, Homo sapiens; identical to SEQ ID NO: 536323
  misc_feature: HIJSMM301D51FJ.10.2.A02.1.454.light.4.raw

SEQ ID NO: 600614 - DNA, 492 bp, Homo sapiens
  misc_feature: HIJSMM301DV1O8.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaaacgactgtggctgcaccatctgtcttcatcttcccgccat

SEQ ID NO: 600615 - DNA, 513 bp, Homo sapiens
  misc_feature: HIJSMM301EIU3H.40.42.D09.1.454.light.4.raw
tctagcgactcacgaccggtgctcgatttagacacatacgcagggaaagggggggcctaaggaagcagcactggtggtgcctcagccatggcctggaccgttctcctcctcggcctcctctctcactgcacagggtctgtgacctcctatgtgctgactcagccactctcggtgtctgtggccccaggacaggcggccaatgttacctgtgggggagacaacattgggagtaaaagtgtgcactggtaccagctgaagccaggccaggcccctgtgttggtcgtctttggacatggtgcccgaccctcggggatccctgagcgattctctgcctccaggtctgggaacacggccaccctgaccatcaccagggtcgaggccggagatgaggccgactatttttgtcacgtgtggcacgttagtcatcacgtcttcggaactggaccacggtcaccgtcctaagtcagcccaaggccaaccccactgtcactctgttcccaccctcctcagtcg

SEQ ID NO: 600616 - DNA, 495 bp, Homo sapiens
  misc_feature: HIJSMM301D695Y.51.81.H04.1.454.light.4.raw
cgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctggtcagcccaaggccaaccccactgtcactctcg

SEQ ID NO: 600617 - DNA, 490 bp, Homo sapiens
  misc_feature: HIJSMM301BHQ1A.14.56.F01.1.454.light.4.raw
cgtctagtaccacgaccggtgctcgatttagcagacgtctgaacacacaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggtggtacaaacggaactgtggctgcaccatctgtt

SEQ ID NO: 600618 - DNA, 476 bp, Homo sapiens; identical to SEQ ID NO: 538026
  misc_feature: HIJSMM301C1YU5.13.76.G10.1.454.light.4.raw

SEQ ID NO: 600619 - DNA, 503 bp, Homo sapiens; identical to SEQ ID NO: 543299
  misc_feature: HIJSMM301APN1R.48.36.D03.1.454.light.4.raw

SEQ ID NO: 600620 - DNA, 502 bp, Homo sapiens; identical to SEQ ID NO: 598791
  misc_feature: HIJSMM301BN9IS.41.14.B03.1.454.light.4.raw

SEQ ID NO: 600621 - DNA, 503 bp, Homo sapiens; identical to SEQ ID NO: 538973
  misc_feature: HIJSMM301D6VIT.5.86.H09.1.454.light.4.raw

SEQ ID NO: 600622 - DNA, 473 bp, Homo sapiens
  misc_feature: HIJSMM301AVJ6I.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggccctggactgaagtgcatatgaagagaactgtggctg

SEQ ID NO: 600623 - DNA, 509 bp, Homo sapiens; identical to SEQ ID NO: 540854
  misc_feature: HIJSMM301A1LA7.4.71.G05.1.454.light.4.raw

SEQ ID NO: 600624 - DNA, 444 bp, Homo sapiens
  misc_feature: HIJSMM301CT5UE.2.76.G10.1.454.light.4.raw
acgctcgacacacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctcggtcactctgttcctgccctcctctgtcgagcgt

SEQ ID NO: 600625 - DNA, 447 bp, Homo sapiens; identical to SEQ ID NO: 535201
  misc_feature: HIJSMM301COP1N.18.9.A09.1.454.light.4.raw

SEQ ID NO: 600626 - DNA, 490 bp, Homo sapiens
  misc_feature: HIJSMM301D5YQH.8.53.E09.1.454.light.4.raw
ctcgcgtgtccacgaccggtgctcgatttagagagagtgtgttgggtttgggggctctgcttcagctgtgggcacaagaggaagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgacccg

SEQ ID NO: 600627 - DNA, 495 bp, Homo sapiens; identical to SEQ ID NO: 535007
  misc_feature: HIJSMM301EUAPR.22.5.A05.1.454.light.4.raw

SEQ ID NO: 600628 - DNA, 499 bp, Homo sapiens; identical to SEQ ID NO: 545732
  misc_feature: HIJSMM301EHU7N.3.33.C11.1.454.light.4.raw

SEQ ID NO: 600629 - DNA, 514 bp, Homo sapiens; identical to SEQ ID NO: 572493
  misc_feature: HIJSMM301ADW1W.16.66.F11.1.454.light.4.raw

SEQ ID NO: 600630 - DNA, 493 bp, Homo sapiens
  misc_feature: HIJSMM301BHZEM.4.43.D10.1.454.light.4.raw
agcactgtagcacgaccggtgctcgatttagactagcagtaaggggggagtcagtctcagtcaggacacagcatggacatgagggtccccgctcagctcctggggctcctgctactctggctccgaggtggcagatgtgacatccagatgacccagtctccatcctccctgtctgcatctgtaggggacagcgtcaccatcacttgccggacaagtcagagcattaaccggtatttaaattggtatcagcaaaaaccaggggaagcccctaaactcctgatctatgctgcatccactttgcacagtggggtcccatcgaggttcagtggcagtggagctgggacagatttcactctcaccatcagcagtctgcaacctgaagatttgcaacttacttctgtcaacagagttacagttcccggacgttcggtccgaacgggaaccgaaagtaggaaagtacaatacgaactagtggctgcaccactctgtcttc

SEQ ID NO: 600631 - DNA, 486 bp, Homo sapiens; identical to SEQ ID NO: 558530
  misc_feature: HIJSMM301AHYH2.43.36.D03.1.454.light.4.raw

SEQ ID NO: 600632 - DNA, 486 bp, Homo sapiens; identical to SEQ ID NO: 537583
  misc_feature: HIJSMM301DXOMZ.17.25.C03.1.454.light.4.raw

SEQ ID NO: 600633 - DNA, 488 bp, Homo sapiens; identical to SEQ ID NO: 535081
  misc_feature: HIJSMM301AULSO.26.23.C01.1.454.light.4.raw

SEQ ID NO: 600634 - DNA, 472 bp, Homo sapiens; identical to SEQ ID NO: 535898
  misc_feature: HIJSMM301EOILE.15.8.A08.1.454.light.4.raw

SEQ ID NO: 600635 - DNA, 508 bp, Homo sapiens; identical to SEQ ID NO: 552440
  misc_feature: HIJSMM301C8923.5.24.C02.1.454.light.4.raw

SEQ ID NO: 600636 - DNA, 447 bp, Homo sapiens; identical to SEQ ID NO: 535201
  misc_feature: HIJSMM301DRQ7E.18.9.A09.1.454.light.4.raw

SEQ ID NO: 600637 - DNA, 503 bp, Homo sapiens
  misc_feature: HIJSMM301C17UM.15.66.F11.1.454.light.4.raw
tctacgtagccacgaccggtgctcgatttagtcacgcgagaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcaggggtccctgatcgcttctctggctccaagtctggcgactcggcctccctgaccgtctctgggctccagcctgaagatgaggctgattatttctgcggctcatatggagacaattacagctttgtcttcggaagtggaccaaggtcaccgtcctaagtcagcccaaggccaaccccactgtcactctgttcccaccct

SEQ ID NO: 600638 - DNA, 504 bp, Homo sapiens
  misc_feature: HIJSMM301CNLYV.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggactgggaccaagatcaccgtcctaggtcagcccaaaggccaaccccactgtcta

SEQ ID NO: 600639 - DNA, 481 bp, Homo sapiens
  misc_feature: HIJSMM301BY7A0.12.10.A10.1.454.light.4.raw
atacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaaagcccctaacgtcctgatctatggtgcatccactttgcatagtggggtcccatcaaggttcagcggcagtggatctgggacagaattcactctcacaatcaccagcctgcagcctgaagattttgcaacttattactgtcaacaggtttatatttaccctcgtattttcggcccttgggaccacagtagatatacaaacgaactgtggctgcacc

SEQ ID NO: 600640 - DNA, 464 bp, Homo sapiens; identical to SEQ ID NO: 537982
  misc_feature: HIJSMM301BEBY3.17.28.C06.1.454.light.4.raw

SEQ ID NO: 600641 - DNA, 498 bp, Homo sapiens
  misc_feature: HIJSMM301BO7K0.52.60.F05.1.454.light.4.raw
cgcagtacgacacgaccggtgctcgatttagtacgtcatcagggaaagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgcttctctggctccacctcagggacaatggtcacattgaccatcagtggagtccaggcagaagacgaggctgactatttctgtcaatcttcagacatcagtggtacttatgtcttcggaactgggaccaaggtcaccgtcctaggtcagcccaaggccaaccccactgtcactctcg

SEQ ID NO: 600642 - DNA, 447 bp, Homo sapiens; identical to SEQ ID NO: 535201
  misc_feature: HIJSMM301ERLF2.18.9.A09.1.454.light.4.raw

SEQ ID NO: 600643 - DNA, 486 bp, Homo sapiens
  misc_feature: HIJSMM301B9BS0.22.77.G11.1.454.light.4.raw
acatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatcctcccggtctgcatctgttggagaaagaatcaccatcacttgtcgggcaagtcagagcattgatatccttttaaactggtatcatcagagaccagggaaggcccctaagttcctgatccatgatgcatccactctgcagagtggagtcccatccaggttcagtggcagtgggtctgggacagagttcactctcaccatcaacagtctgcagccagaggactttggaacctactattgccaacagacttacacgtacccccccacgttccggcggagggaccacagtcgagatacaaacgaactgtggctgcaccat

SEQ ID NO: 600644 - DNA, 494 bp, Homo sapiens
  misc_feature: HIJSMM301B73DK.51.28.C06.1.454.light.4.raw
cgatcgtatacacgaccggtgctcgatttagagctcacgtattgggtttggggtgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacagcgacactgccgtgttcggcgggggaccaagctgaccgtcctcggtcagcccaaggctgccccctcggtctacc

SEQ ID NO: 600645 - DNA, 504 bp, Homo sapiens; identical to SEQ ID NO: 562185
  misc_feature: HIJSMM301B1SGE.48.35.D02.1.454.light.4.raw

SEQ ID NO: 600646 - DNA, 491 bp, Homo sapiens
  misc_feature: HIJSMM301CJ75M.9.34.D01.1.454.light.4.raw
tgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggaacagcccccaaagtcatcatttatgacaacatgaagcggccctcagggtccctgaccgattctccggctccaagtctggcacatcagcctccctggccatcactgggctccaggctgaggatgaggctgactatactgccagtcgtatgacagtggcctaagtaacatcgtcttcggaactgggaccaaggtcaccgtccg

SEQ ID NO: 600647 - DNA, 493 bp, Homo sapiens; identical to SEQ ID NO: 535745
  misc_feature: HIJSMM301DYD4P.47.78.H01.1.454.light.4.raw

SEQ ID NO: 600648 - DNA, 500 bp, Homo sapiens
  misc_feature: HIJSMM301DLNI3.52.65.F10.1.454.light.4.raw
cgcagtacgacacgaccggtgctcgatttagctacgctctaagggggcaggagtcagacccagtcaggacacagcatggacatgagggtccccgctcagctcctggggctcctgctgctctggttcccaggtgccaggtgcgacatccagatgacccagtctccatcttccgtgtctgcatctgtaggagacagagtcaccatcacttgtcgggcgagtcaggttgttagcgcctggttagcctggtatcagcagaaaccagggaaagcccctaaagtcctggtctatgctacatccaatttgcaaagtggcgtccctcaaggttccgcggcagtggatctgggacaaatttcactctcaccatcagcagcctgcagcctgaagtattttgcgacttactattgtcaacaggggtacagttttccgtacacctttggccaggggactaagctggacatacaaacgaactgtggctgcaccatctgtcttcatcttccccg

SEQ ID NO: 600649 - DNA, 486 bp, Homo sapiens; identical to SEQ ID NO: 535917
  misc_feature: HIJSMM301DPA7L.3.10.A10.1.454.light.4.raw

SEQ ID NO: 600650 - DNA, 445 bp, Homo sapiens
  misc_feature: HIJSMM301C3JE6.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcggaccaagttgaccgtcctacgtcagcccaaggctcgccccctcggtcactctcgttcccaccctcctcgacacgcgag

SEQ ID NO: 600651 - DNA, 497 bp, Homo sapiens
  misc_feature: HIJSMM301CGTMB.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtggaaaatcaaacgaactgtggctgcacc

SEQ ID NO: 600652 - DNA, 444 bp, Homo sapiens; identical to SEQ ID NO: 535411
  misc_feature: HIJSMM301BE1RC.8.73.G07.1.454.light.4.raw

SEQ ID NO: 600653 - DNA, 483 bp, Homo sapiens; identical to SEQ ID NO: 540738
  misc_feature: HIJSMM301BH0QO.48.85.H08.1.454.light.4.raw

SEQ ID NO: 600654 - DNA, 493 bp, Homo sapiens
  misc_feature: HIJSMM301CAOJW.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgactagtggctgcacatctgtctt

SEQ ID NO: 600655 - DNA, 522 bp, Homo sapiens
  misc_feature: HIJSMM301EKR3A.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaacccccactcgtcactctgttcccaccctcct

SEQ ID NO: 600656 - DNA, 389 bp, Homo sapiens; identical to SEQ ID NO: 540091
  misc_feature: HIJSMM301CIVDH.21.40.D07.1.454.light.4.raw

SEQ ID NO: 600657 - DNA, 517 bp, Homo sapiens; identical to SEQ ID NO: 561441
  misc_feature: HIJSMM301BCYOV.48.17.B06.1.454.light.4.raw

SEQ ID NO: 600658 - DNA, 490 bp, Homo sapiens
  misc_feature: HIJSMM301CAUKK.43.37.D04.1.454.light.4.raw
tgtgagtagtcacgaccggtgctcgatttagtagcatactgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaagcagcagtgacattggtggttatacatatgtctcctggtaccaacagcacccaggcaaagcccccaaactcatgatttatgaggtcaataagcggccgtcaggggtccctgatcgcttctctggctccaagtctggcaacacggccaccctgaccgtctctgggctccaggctgaggatgaggctcattattactgcagctcatatacaggcaacaagaatttggtgttcggcggagggaccgagctgaccgtctaggtcagcccaagg

SEQ ID NO: 600659 - DNA, 487 bp, Homo sapiens; identical to SEQ ID NO: 535583
  misc_feature: HIJSMM301EEHRA.22.73.G07.1.454.light.4.raw

SEQ ID NO: 600660 - DNA, 520 bp, Homo sapiens
  misc_feature: HIJSMM301DN5FP.9.14.B03.1.454.light.4.raw
tgatacgtctcacgaccggtgctcgatttagtgtgagtagttccgcgggggtgggctcaggaggcagagctctgggaatctcaccatggcctggacccctctcctgctccccctcctcactttctgcacagtctctgaggcctcctatgatctgacacagccaccctcggtgtcagtgtccccaggacagacggccaggatcacctgctctggagatggattatacaaaaaaatatgtttattggtaccaacagaagtcaggccaggccccccttctagtcatctatgaggacgccaggccgaccctccgggatccctgagagaatctcgggctccagttcagggacagtggccaccttgacgatcggtgggcccaggtggaagatgaagctgactacttctgttactcaacagacgacagtgcggatcatagagggatggttcggcggagggaccaagctgaccgtcctaggtcagcccaaggctcgccccctcggtcactctcgttcccgccctcctc

SEQ ID NO: 600661 - DNA, 493 bp, Homo sapiens
  misc_feature: HIJSMM301DPKHU.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggtagggaccaaggtggaggtcaaaacgaactgtggctgcaccatctgtcttcatt

SEQ ID NO: 600662 - DNA, 506 bp, Homo sapiens
  misc_feature: HIJSMM301BME14.21.87.H10.1.454.light.4.raw
tcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaaactcttaatttctggcgtcaatcagcgaccctcacatgtttccagtcgattctctgcatccaagtctggcaacacggcctttctgacaatctctcaactccaggctgaagacgaggctatttattactgctcctcatacgcaggtggcacatttttcttggtttttggcggcgggaccctgatgactgtcctcagtcagcccaaggctgccccctcggt

SEQ ID NO: 600663 - DNA, 383 bp, Homo sapiens; identical to SEQ ID NO: 447524
  misc_feature: HIJSMM301EHH05.41.26.C04.1.454.light.4.raw

SEQ ID NO: 600664 - DNA, 492 bp, Homo sapiens
  misc_feature: HIJSMM301BEYN0.51.29.C07.1.454.light.4.raw
cgatcgtatacacgaccggtgctcgatttagagtgctacgaagggaaagggggagggaactgctcagtcaggacccagacggaaccatggaagccccagcgcagcttctcttcctcctgctactctggctcccagatactactggagaaatagtgatgacgcagtctccagccacgctgtctgtgtctccgaggggaaagagccaccctctcctgcagggccagtcagagtgttaacacaacttagcctggtatcagcagaaacctggccaggctcccaggctcctcatctttggatcatccatcagggccactggtgtcccagaaaagttcagtggcggtgggtctgacacagagtacaccctcaccatcagcaccctgcagtctgaagatgtcgcagtttattactgtcaacatatagtgacaggccgccatggacgttcggccaagggaccaaggtggaatgaaaggactgtgctgcaccatctgtctt

SEQ ID NO: 600665 - DNA, 488 bp, Homo sapiens; identical to SEQ ID NO: 537527
  misc_feature: HIJSMM301ELQI2.26.78.H01.1.454.light.4.raw

SEQ ID NO: 600666 - DNA, 482 bp, Homo sapiens; identical to SEQ ID NO: 574226
  misc_feature: HIJSMM301A98X7.21.25.C03.1.454.light.4.raw

SEQ ID NO: 600667 - DNA, 484 bp, Homo sapiens
  misc_feature: HIJSMM301CW6OM.17.34.D01.1.454.light.4.raw
cgtagactagcacgaccggtgctcgatttagatcgtctgtgttgggtttgggtcatcacaatatctgcactggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggtcagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccaagggaccaaggtggaactcaaacgaactgtggctgcaccatctgtcttcatcttcccgccatctgactagtctacg

SEQ ID NO: 600668 - DNA, 495 bp, Homo sapiens
  misc_feature: HIJSMM301DICQ6.10.37.D04.1.454.light.4.raw
  modified_base (416)..(416): a, c, t, g, unknown or other
catagtagtgcacgaccggtgctcgatttagtagcatactgttgggtttgggggctctggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaagcctggccaggttcccagactcctcatatatgaagcctcttccagggccactggagtcccagccaggttcagcggcggtgggtctgggacagacttcactctcaccatcagcagcctgcagtctgaggaccttggagtttattacngtcggcagtatcataactggcctcgtggacgttcggccaagggaccaaggtggacctcaaacgaactgtggctgcacca

SEQ ID NO: 600669 - DNA, 511 bp, Homo sapiens; identical to SEQ ID NO: 549837
  misc_feature: HIJSMM301BK1SN.15.34.D01.1.454.light.4.raw

SEQ ID NO: 600670 - DNA, 518 bp, Homo sapiens
  misc_feature: HIJSMM301AYY1F.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccacggaccgaacggtaggaagtacgaaacgaacgtagtaggcgtgcgaccactctcgtcttctatcttcccgtcccact

SEQ ID NO: 600671 - DNA, 449 bp, Homo sapiens
  misc_feature: HIJSMM301CC8CM.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctcgttcccgccctcctaccatactcgta

SEQ ID NO: 600672 - DNA, 488 bp, Homo sapiens
  misc_feature: HIJSMM301B9UO1.15.49.E05.1.454.light.4.raw
tctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgctagtttattactgtcagcagtataatgactggcctccgacgttcggccagggaccaaggtggaatcaaacgaactagtggctgcaccat

SEQ ID NO: 600673 - DNA, 483 bp, Homo sapiens
  misc_feature: HIJSMM301C49PF.43.60.F05.1.454.light.4.raw
  modified_base (443)..(443): a, c, t, g, unknown or other
  modified_base (457)..(457): a, c, t, g, unknown or other
tgtgagtagtcacgaccggtgctcgatttagtacgtcatcagggaaagggggcaggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccttcggacgtgtccnggacgacgcggagngtcagacgactacgtgcgtgcgacca

SEQ ID NO: 600674 - DNA, 488 bp, Homo sapiens; identical to SEQ ID NO: 537527
  misc_feature: HIJSMM301D1P1V.26.78.H01.1.454.light.4.raw

SEQ ID NO: 600675 - DNA, 493 bp, Homo sapiens; identical to SEQ ID NO: 575859
  misc_feature: HIJSMM301EQXPF.8.81.H04.1.454.light.4.raw

SEQ ID NO: 600676 - DNA, 385 bp, Homo sapiens
  misc_feature: HIJSMM301C18J1.48.87.H10.1.454.light.4.raw
agtatacatacacgaccggtgctcgatttagcagtactgcgttgggtttgggggctacaacaggcaggcagggggcagcaagatggtgttgcagacccaggtcttcatttctctgttgctctggatctctggtgcctacgggaacatcgtgatgaaccagtctccagagtccctggctgtgtctctgggcgagagggccaccatctactgcaagtccagccagagtcttttttcacacaaccaatgagaagaactacttagcttggtaccagcagagaccaggacaacctcctaagttgctcttttactgggcgtcttcccgggagtccggggtccctgaccgattcagtgccagcgggtctggggacagacttcactctcacca

SEQ ID NO: 600677 - DNA, 497 bp, Homo sapiens
  misc_feature: HIJSMM301EGZO2.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccgaggtcaccgtcctaggtcagcccaagg

SEQ ID NO: 600678 - DNA, 488 bp, Homo sapiens; identical to SEQ ID NO: 537673
  misc_feature: HIJSMM301DQ8XP.12.31.C09.1.454.light.4.raw

SEQ ID NO: 600679 - DNA, 487 bp, Homo sapiens; identical to SEQ ID NO: 563302
  misc_feature: HIJSMM301BOX8D.11.25.C03.1.454.light.4.raw

SEQ ID NO: 600680 - DNA, 500 bp, Homo sapiens; identical to SEQ ID NO: 556015
  misc_feature: HIJSMM301B5COZ.21.38.D05.1.454.light.4.raw

SEQ ID NO: 600681 - DNA, 506 bp, Homo sapiens
  misc_feature: HIJSMM301BLTZU.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctggtcagcccaaggctgccccctcggtcctac

SEQ ID NO: 600682 - DNA, 518 bp, Homo sapiens
  misc_feature: HIJSMM301EZKTQ.12.85.H08.1.454.light.4.raw
atacgacgtacacgaccggtgctcgatttagtatcactcagtcgcggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttggtcgttataactttgtctcctggtacaaacagcacccaggcaaaagccccccaactcctgatttatgaggtcactattcggtcctcaggaatttctaatcgcttctctggttccaagtctggcaacacggcctccctgacccatctctggggtccaggctgaggacgaggctgattattactgcagttcatatacaagcacttccactctcgtggtgttcggcggtgggaccaagctgaccgtcctaagtcagcccaaggctgccccctcggtcactctgttccca

SEQ ID NO: 600683 - DNA, 485 bp, Homo sapiens; identical to SEQ ID NO: 535606
  misc_feature: HIJSMM301AFFU3.47.46.E02.1.454.light.4.raw

SEQ ID NO: 600684 - DNA, 490 bp, Homo sapiens
  misc_feature: HIJSMM301A7E10.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggcctcaggggtttctaatcgcttctctggctccaagtctggcaacacggcctcctgaccatctctgggctccaggctgaggacgaggctgattattactgcagctcatatacaagcaccagcactctctatgtcttcggaactggaccaaggtcacgtctagtcagcccaga

SEQ ID NO: 600685 - DNA, 491 bp, Homo sapiens
  misc_feature: HIJSMM301EB351.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagattttcactctcaccgtcagcagtctgcaacctgaaagattttgcaacttactactgtcaacagagttacagtacccccctcactttcggcggagggaccaaggcggagatcagacgaactgtggctgcaccatctgtcttcta

SEQ ID NO: 600686 - DNA, 500 bp, Homo sapiens
  misc_feature: HIJSMM301BCQLQ.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtctgcgtcagcccaaggctgccccctcggtcact

SEQ ID NO: 600687 - DNA, 510 bp, Homo sapiens
  misc_feature: HIJSMM301DLCTR.53.71.G05.1.454.light.4.raw
cgcgtatacacacgaccggtgctcgatttagtgtcgtcgcaagagagagggggctgggcctaaggaagcagcactggtggtgcctcagccatggcctggaccgttctcctcctcggcctcctctctcactgcacaggctctgtgacctcctatctattgactcagccaccctcggtgtcagtggccccaggaaggacggccacgatgacctgtgcaggaaacaacattggaagtaaaagtgtgcactggtaccagcacaggccaggccaggcccctgcgctggtcgtctatgatgatagcgaccggccctcagggatccctgagcgattctctggctccaactctggggacacggccaccctgaccatcagcagggtcgaagccggagacgaggccgactattactgtcaggtgtgggattttaatagtgatcattgggtgttcggcggagggaccaagctgaccgtcctaggtcagcccaaggctgcccctcggtcactctgttccccg

SEQ ID NO: 600688 - DNA, 497 bp, Homo sapiens; identical to SEQ ID NO: 536371
  misc_feature: HIJSMM301E084T.16.78.H01.1.454.light.4.raw

SEQ ID NO: 600689 - DNA, 484 bp, Homo sapiens; identical to SEQ ID NO: 535400
  misc_feature: HIJSMM301C2PB6.46.26.C04.1.454.light.4.raw

SEQ ID NO: 600690 - DNA, 494 bp, Homo sapiens
  misc_feature: HIJSMM301EYLX5.19.71.G05.1.454.light.4.raw
tactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctagactgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccgaaggtggagtatcagacgaa

SEQ ID NO: 600691 - DNA, 525 bp, Homo sapiens
  misc_feature: HIJSMM301EQCGB.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggccgaaggggaccaaagggtggaaggtctaaaccgaaacgtacgtggcgtcgtcgaccactacttcgttcttctta

SEQ ID NO: 600692 - DNA, 476 bp, Homo sapiens; identical to SEQ ID NO: 587673
  misc_feature: HIJSMM301BLUYM.4.63.F08.1.454.light.4.raw

SEQ ID NO: 600693 - DNA, 496 bp, Homo sapiens
  misc_feature: HIJSMM301CEGBE.9.34.D01.1.454.light.4.raw
tgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctgaggatggaggctgacttattactcgccagtcgtatgacaggtggacctaagtaacatcgtcgtcggacgtggaccaaggtcaccgtcc

SEQ ID NO: 600694 - DNA, 371 bp, Homo sapiens
  misc_feature: HIJSMM301DI1R0.9.11.A11.1.454.light.4.raw
tgatacgtctcacgaccggtgctcgatttagctacgactgcaggggagagagccaccctctcttgcaggaccagtctgcatattcccagcacctacgtagcctggtaccagcagaaacctggccagtctcccaggctcctcatctatggtgcgtccaccagggccactggcatcccagaccgcttcagttccagtgggtctgggacagacttcactctcaccatccgcggactggagcctgaagattttgcagtgtattactgtcagcagtatcataggtcaaacaccttcggccaagggacacgactggagattaaaggaactgtggctgcaccatctgtcttcatcttccgccatctgaagacgtatca

SEQ ID NO: 600695 - DNA, 493 bp, Homo sapiens; identical to SEQ ID NO: 539015
  misc_feature: HIJSMM301DG5PR.27.78.H01.1.454.light.4.raw

SEQ ID NO: 600696 - DNA, 494 bp, Homo sapiens
  misc_feature: HIJSMM301DVT7I.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccaggggaccaagctggagatcaaacgaactagtgg

SEQ ID NO: 600697 - DNA, 483 bp, Homo sapiens; identical to SEQ ID NO: 540738
  misc_feature: HIJSMM301C9BXW.48.85.H08.1.454.light.4.raw

SEQ ID NO: 600698 - DNA, 482 bp, Homo sapiens; identical to SEQ ID NO: 595782
  misc_feature: HIJSMM301B2CAM.4.1.A01.1.454.light.4.raw

SEQ ID NO: 600699 - DNA, 519 bp, Homo sapiens
  misc_feature: HIJSMM301CV4XR.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggtcggagggaccgaaggtaggaccgtcaaacgaaactagtggctgcaccatctgttcttctactcttcccgtcccact

SEQ ID NO: 600700 - DNA, 487 bp, Homo sapiens; identical to SEQ ID NO: 536206
  misc_feature: HIJSMM301EUNNN.47.38.D05.1.454.light.4.raw

SEQ ID NO: 600701 - DNA, 436 bp, Homo sapiens
  misc_feature: HIJSMM301ANSMG.18.5.A05.1.454.light.4.raw
tacgagtatgcacgaccggtgctcgatttagatagatagacagggtggaaggagactgggacatccagatgacccagtctccttccaccctgtctgcatctgtaggagacagagtcaccatctcttgccgggccactcagagtattagtatctggttggcctggtatcagcagaaaccagggaaagcccctaagctcctgatcgagaaggcgtctagtttagaaagtggggtcccatcaaggtttagcggcagtggatctgggacagaattcactctcaccatcagcagcctgcagcctgatgatttttgcaacttattactgccaacattataatacttattcgtacacttttggccaggggaccaagctggagatacaaacgaactgtggctgcaccatctgtcttcatcttcccgccatctgacatactcgta

SEQ ID NO: 600702 - DNA, 480 bp, Homo sapiens
  misc_feature: HIJSMM301DAUPX.51.29.C07.1.454.light.4.raw
cgatcgtatacacgaccggtgctcgatttagagtgctacgaagggaaagggggaatcagtcccactcaggacacagcatggacatgagggtccccgctcagctcctggggctcctgctgctctggttcccaggtcccaggtgtgacatccagatgacccagtctccaccctccctgtctgcttctgtacgagacagagtcaccatcacttgccggacaagtcagggcactagaagttctttaggctcctttcagcagagaccagggaaagcccctacgcgccttaactatgttacattcagtttgcaaagtggcgtcccatcaaggtccagcggcattggatctggggcagaattcactctcacattcagcagcctgcagcctgaagatttttcaacttataagtgtctacatcataattcttggaggagatcacacgaactgtggctgcaccatctgtcttcatcttcccgccatctga

SEQ ID NO: 600703 - DNA, 518 bp, Homo sapiens
  misc_feature: HIJSMM301AE6F6.41.35.D02.1.454.light.4.raw
tctatactatcacgaccggtgctcgatttagcacacgatagttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaaccccactgtcactctgttccccg

SEQ ID NO: 600704 - DNA, 496 bp, Homo sapiens
  misc_feature: HIJSMM301BAVG8.52.38.D05.1.454.light.4.raw
cgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtctgggtcagcccaaggccaaccccactgtcactc

SEQ ID NO: 600705 - DNA, 501 bp, Homo sapiens
  misc_feature: HIJSMM301AL24G.10.43.D10.1.454.light.4.raw
catagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccggggccactttcggccctgggaccaaagtggagtatcaaacgaactgtggctgcaccatctgtcttcat

SEQ ID NO: 600706 - DNA, 498 bp, Homo sapiens
  misc_feature: HIJSMM301EK50G.16.10.A10.1.454.light.4.raw
tgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagaggccctcagggatccctgggcgattctctggctccagctcagggacgacagtcacgttgaccatcggtggagtccaggcagaagacgagggtgactattactgtcagtctgcaaacaccactgcagcggtgttcggcggagggaccaagctgaccgtcctgcgtcagcccaaggctcgccccctcggtccactctcgttccca

SEQ ID NO: 600707 - DNA, 494 bp, Homo sapiens
  misc_feature: HIJSMM301CBYLS.40.57.F02.1.454.light.4.raw
tctagcgactcacgaccggtgctcgatttagctcgatatagttgggtttggggctggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgctgctcttatgcaggcagtttcgctctcgaagtgttcggcggagggaccgagctgaccgtcctacgtcagcccaac

SEQ ID NO: 600708 - DNA, 503 bp, Homo sapiens
  misc_feature: HIJSMM301BY6XU.27.78.H01.1.454.light.4.raw
agcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcacccttcggccaagggacacgactaggagtaattaaacgaacctgtggcgtgacaccatctgttt

SEQ ID NO: 600709 - DNA, 513 bp, Homo sapiens
  misc_feature: HIJSMM301EBW3O.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggccaagctgaccgtcttaagtcagcccaaggctgccccctcggtcactctgttcccacctcctcc

SEQ ID NO: 600710 - DNA, 503 bp, Homo sapiens; identical to SEQ ID NO: 551625
  misc_feature: HIJSMM301D9QZ6.10.71.G05.1.454.light.4.raw

SEQ ID NO: 600711 - DNA, 485 bp, Homo sapiens; identical to SEQ ID NO: 536040
  misc_feature: HIJSMM301DM14Z.15.1.A01.1.454.light.4.raw

SEQ ID NO: 600712 - DNA, 486 bp, Homo sapiens; identical to SEQ ID NO: 538219
  misc_feature: HIJSMM301CFRSX.47.70.G04.1.454.light.4.raw

SEQ ID NO: 600713 - DNA, 518 bp, Homo sapiens
  misc_feature: HIJSMM301ENEC8.16.83.H06.1.454.light.4.raw
tgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtgggggaaacggccttggacgtaaaagtgtgcactggtaccagcagaagccaggccaggcccctgtgctggtcgtctatgatgatagcgaccggccctcagggatccctgagcgattctctggctccaactctgggaacgcggccaccctgaccatcagcagggtcgaagccggggatgaggccgactattactgtcaggtgtgggatagtagtagtgatcattatgtcttcggatctgggaccagggtcaccgtcctaggtcagcccaacggccaaccccactgtcactctcgttcccaccctccc

SEQ ID NO: 600714 - DNA, 494 bp, Homo sapiens; identical to SEQ ID NO: 534994
  misc_feature: HIJSMM301DF6LW.27.78.H01.1.454.light.4.raw

SEQ ID NO: 600715 - DNA, 503 bp, Homo sapiens
  misc_feature: HIJSMM301EEUX5.21.22.B11.1.454.light.4.raw
  modified_base (430)..(430): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagccctccctgaccatcagtgggctccggtccgaggatgaggctgactattactgtgcatcacgggacncaacatgggatgacaatctgagcggttggtggttcggcggagggaccaaactgaccgtcctaggtcagcccaa

SEQ ID NO: 600716 - DNA, 520 bp, Homo sapiens
  misc_feature: HIJSMM301D6WEA.49.35.D02.1.454.light.4.raw
agtcgagagacacgaccggtgctcgatttagcacacgatagttgggtttgggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtagaaaatcacagaggaatattcggcggagggaccaagctgaccgtcctaggtcagcccaaggctcgccccctcggtcactctgttcccaccctcct

SEQ ID NO: 600717 - DNA, 497 bp, Homo sapiens; identical to SEQ ID NO: 554406
  misc_feature: HIJSMM301EGXYV.3.33.C11.1.454.light.4.raw

SEQ ID NO: 600718 - DNA, 492 bp, Homo sapiens; identical to SEQ ID NO: 535126
  misc_feature: HIJSMM301D281D.18.11.A11.1.454.light.4.raw

SEQ ID NO: 600719 - DNA, 488 bp, Homo sapiens
  misc_feature: HIJSMM301B6KBX.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgcctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaaggctggagatcaaacgaactgtggctgcaccat

SEQ ID NO: 600720 - DNA, 484 bp, Homo sapiens; identical to SEQ ID NO: 537427
  misc_feature: HIJSMM301D1TNA.26.78.H01.1.454.light.4.raw

SEQ ID NO: 600721 - DNA, 484 bp, Homo sapiens; identical to SEQ ID NO: 540581
  misc_feature: HIJSMM301BB38U.3.88.H11.1.454.light.4.raw

SEQ ID NO: 600722 - DNA, 497 bp, Homo sapiens
  misc_feature: HIJSMM301APPP3.40.37.D04.1.454.light.4.raw
tctagcgactcacgaccggtgctcgatttagtagcatactgttgggtttgggggatcaggacttctcagttcatcttctcaccatgaggctccctgctcagctcctggggctgctaatgctctggatccctggttccagtgcgagggttgtgatgactcagactccactctctctgtccgtcacccctggacagccggcctccatctcctgcaagtctgctcagagcctcctgcatggtgatggaatcacctatttatattggtacctgcagaagccaggccagtctccacagctcctaatctatgaggtttccagccggttctctggagtgccagataggttcagtggcagcgggtcagtgacagatttcacactgaaaatcagccgggtggaggctgaggatgttggggtttattactgcgatgcaaggtttataccttaacctcggactttcggtccctcggaccgacgagtggagtgtctaacgaaactacgt

SEQ ID NO: 600723 - DNA, 493 bp, Homo sapiens
  misc_feature: HIJSMM301ESAU1.52.31.C09.1.454.light.4.raw
cgcagtacgacacgaccggtgctcgatttagacgtctcatcaaggaaggaagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaggtcaggccaggcccctatattgatcatctatgaagacagcaaacgacccgctgggatccctcagagattctctggctccagctcagggacaatggccaccttgactatcactggggcccaggtggaggatgaagctgccttctattgttttcaacagacagcagtggtaatcatagggtgttcggcggagggccaggctgaccgtctaggtcagccaaggctgccccctcggt

SEQ ID NO: 600724 - DNA, 484 bp, Homo sapiens
  misc_feature: HIJSMM301D5COT.41.37.D04.1.454.light.4.raw
tctatactatcacgaccggtgctcgatttagtagcatactgttgggtttgggggatcaggacttctcagttcatcttctcaccatgaggctccctgctcagctcctggggctgctaatgctctggatacctggatccagtgcagatattgtgatgtcccagactccactctctctgtccgtcacccctggacagccggcctccatctcctgcaagtctagtcagagtctcctccatgagaatggcaaaacttatttctactggtacctacagaaggcaggccagccgccacagctcctgatctatgaggttttcaggcggttctctggagtgccagacaggttcagtggcagcgggtccgggacagatttcacactgaggatcagtcgggtggaggctgacgacgttgggacttattactgcgcgcaaagtctacaccttcctctcactttgggccctgggaccaaagtggacatacaaacgaa

SEQ ID NO: 600725 - DNA, 483 bp, Homo sapiens
  misc_feature: HIJSMM301EGWGB.48.34.D01.1.454.light.4.raw
agtatacatacacgaccggtgctcgatttagatcgtctgtgttgggtttggggggagaagagctgctcagttaggacccagagggaaccatggaaaccccagcgcagcttctcttcctcctaagctactctggctcccagataccaccggagcacttgtgttgacgcagtctccaggcaccctgtctttgtctccaggggagagagccaccctctcctgcagggccagtcagagtgttagcggcggctccgtagcctggtaccagcagaaacgtggccaggttcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacctcaactcactttcggcggagggaccgaaggtggagatcaaacgaa

SEQ ID NO: 600726 - DNA, 491 bp, Homo sapiens
  misc_feature: HIJSMM301DYZU2.14.55.E11.1.454.light.4.raw
cgtctagtaccacgaccggtgctcgatttagcactcgcacgttgggtttggggagtctcagtcaggacacggcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacacgtaccccctcacctttcggcggagggaccaaggcggagatcagacgaactgtggctgcaccatctgtcttcatt

SEQ ID NO: 600727 - DNA, 384 bp, Homo sapiens; identical to SEQ ID NO: 560149
  misc_feature: HIJSMM301B014I.48.34.D01.1.454.light.4.raw

SEQ ID NO: 600728 - DNA, 504 bp, Homo sapiens; identical to SEQ ID NO: 563936
  misc_feature: HIJSMM301BR731.18.59.F04.1.454.light.4.raw

SEQ ID NO: 600729 - DNA, 492 bp, Homo sapiens
  misc_feature: HIJSMM301DLR05.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgctaacttattttgtcaacaggctaacacctttccccctcactttcggcggagggaccaaggtggagatcaagcgaactgtggctgcaccatctgtctt

SEQ ID NO: 600730 - DNA, 489 bp, Homo sapiens
  misc_feature: HIJSMM301CHCER.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctactacttttggccaggggaccaagctggagatacaaacgaa

SEQ ID NO: 600731 - DNA, 489 bp, Homo sapiens
  misc_feature: HIJSMM301EODIX.3.72.G06.1.454.light.4.raw
agacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaagagccactctctcctgcagggccagtcagagtgttagcagctacttagcctggtaccagcagaaacctggccaggctcccaggctcctcatttatgatgcatccaacagggccactggcatcccagccaggttcagtggcagtgggtctgggacagacttcactctcaccatcagcagcctagagcctgaagattttgcagtttattactgtcagcagcgtagcaactggcctctcaccttcggcggagggaccaaggtggagatcaaacgaactgtggctgcacatctgt

SEQ ID NO: 600732 - DNA, 499 bp, Homo sapiens; identical to SEQ ID NO: 564379
  misc_feature: HIJSMM301DVWDN.12.37.D04.1.454.light.4.raw

SEQ ID NO: 600733 - DNA, 477 bp, Homo sapiens; identical to SEQ ID NO: 545166
  misc_feature: HIJSMM301CPS2N.5.28.C06.1.454.light.4.raw

SEQ ID NO: 600734 - DNA, 515 bp, Homo sapiens
  misc_feature: HIJSMM301B4PGY.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccgccctcctcc

SEQ ID NO: 600735 - DNA, 423 bp, Homo sapiens
  misc_feature: HIJSMM301CIEEQ.18.78.H01.1.454.light.4.raw
tacgagtatgcacgaccggtgctcgatttagtgtgagtagtttgggtttgggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaaggcccaaaccccactgtcactctgttccccaccctcctccatactcgta

SEQ ID NO: 600736 - DNA, 494 bp, Homo sapiens; identical to SEQ ID NO: 537091
  misc_feature: HIJSMM301BUK2V.27.78.H01.1.454.light.4.raw
  modified_base (426)..(426): a, c, t, g, unknown or other

SEQ ID NO: 600737 - DNA, 496 bp, Homo sapiens; identical to SEQ ID NO: 566097
  misc_feature: HIJSMM301CZ09P.5.12.B01.1.454.light.4.raw

SEQ ID NO: 600738 - DNA, 501 bp, Homo sapiens
  misc_feature: HIJSMM301E0RIW.53.11.A11.1.454.light.4.raw
cgcgtatacacacgaccggtgctcgatttagctacgactgcagggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaacaatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaaggctgactattactgtcaatctgcggacagcagtggttcttcatgtggtattcggtcgggagggaccaagctgaccgtcctaggtcagcccaaggctgccccctcggtcactcttcg

SEQ ID NO: 600739 - DNA, 383 bp, Homo sapiens; identical to SEQ ID NO: 447524
  misc_feature: HIJSMM301EWYIJ.41.26.C04.1.454.light.4.raw

SEQ ID NO: 600740 - DNA, 494 bp, Homo sapiens; identical to SEQ ID NO: 534992
  misc_feature: HIJSMM301D57SH.9.1.A01.1.454.light.4.raw

SEQ ID NO: 600741 - DNA, 486 bp, Homo sapiens
  misc_feature: HIJSMM301D2XQT.11.12.B01.1.454.light.4.raw
cgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaaataccaggcggccctctggggtccctgagcgattctccggctccggctctgggaacacagtcactctgaccatcagcgggacccaggctattgatgaggctgtctacttctgtcaggcgtgggacaacagcgtggtgttcggcggaggggccagtctgaccgtcttaggtcagccc

SEQ ID NO: 600742 - DNA, 517 bp, Homo sapiens; identical to SEQ ID NO: 548112
  misc_feature: HIJSMM301A2PU7.3.87.H10.1.454.light.4.raw

SEQ ID NO: 600743 - DNA, 508 bp, Homo sapiens; identical to SEQ ID NO: 537871
  misc_feature: HIJSMM301AS7Q1.8.33.C11.1.454.light.4.raw

SEQ ID NO: 600744 - DNA, 499 bp, Homo sapiens
  misc_feature: HIJSMM301BX4LW.43.35.D02.1.454.light.4.raw
tgtgagtagtcacgaccggtgctcgatttagcacacgatagttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaacccc

SEQ ID NO: 600745 - DNA, 484 bp, Homo sapiens; identical to SEQ ID NO: 550726
  misc_feature: HIJSMM301C4B0E.47.62.F07.1.454.light.4.raw

SEQ ID NO: 600746 - DNA, 503 bp, Homo sapiens; identical to SEQ ID NO: 537841
  misc_feature: HIJSMM301D6OLO.48.71.G05.1.454.light.4.raw

SEQ ID NO: 600747 - DNA, 497 bp, Homo sapiens; identical to SEQ ID NO: 543330
  misc_feature: HIJSMM301DCYBX.9.39.D06.1.454.light.4.raw

SEQ ID NO: 600748 - DNA, 497 bp, Homo sapiens
  misc_feature: HIJSMM301EPIDL.43.55.E11.1.454.light.4.raw
tgtgagtagtcacgaccggtgctcgatttagcactcgcacgttgggtttgggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaaagtggggtcccattaaggttcagcggcagtggatctgggacagagtttactctcaccatcagcagcctgcagcctgatgattttgcaacttattactgccaacaatatgattcttggccgtggacgttcggccaagggaccaacgtggaaatacaaacgaaactgtggctgcaccatctgtcttcatt

SEQ ID NO: 600749 - DNA, 444 bp, Homo sapiens; identical to SEQ ID NO: 537971
  misc_feature: HIJSMM301DKJXF.2.76.G10.1.454.light.4.raw

SEQ ID NO: 600750 - DNA, 511 bp, Homo sapiens
  misc_feature: HIJSMM301DP6ML.52.87.H10.1.454.light.4.raw
cgcagtacgacacgaccggtgctcgatttagcagtactgcgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttatgactttgtctcctggtaccaacaccaccctggcaaagcccccaaactcatcatttttgaggtcactaagcggccctcaggggtccctgatcgcttctctggctcgaagtctggcaacacggcctcctgaccgtctctgggctccaggctgaggatgaggctgattactactgcacctcatatgcaggcgacaacaatttgggggttttcgcggagggaccaaggtgaccgtctacgtcagcccaaggctgcccctcggtcactctgtt

SEQ ID NO: 600751 - DNA, 492 bp, Homo sapiens; identical to SEQ ID NO: 541650
  misc_feature: HIJSMM301CP7IJ.5.57.F02.1.454.light.4.raw

SEQ ID NO: 600752 - DNA, 495 bp, Homo sapiens
  misc_feature: HIJSMM301DW4UM.27.78.H01.1.454.light.4.raw
  modified_base (403)..(403): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattacngtcatcagagtactactttacctcaagtgatcaaccttcggccaagggacacgactggagattaaacgaactgtggctgcaccatctgtctt

SEQ ID NO: 600753 - DNA, 518 bp, Homo sapiens
  misc_feature: HIJSMM301DN9F6.41.19.B08.1.454.light.4.raw
tctatactatcacgaccggtgctcgatttagtgagtcagtaagggggctggggtctcaggaggctagcgctctcgggacgtctccaccatggcatgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaaccccactgtcactctgttcccgccct

SEQ ID NO: 600754 - DNA, 504 bp, Homo sapiens
  misc_feature: HIJSMM301A9OH7.13.11.A11.1.454.light.4.raw
tcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgtttgacttggcacaacaacgcctggatcttcggacctgggaccacggtcaccgtcctaggtcagcccaaggcccaaccccactcgtcactctcgtt

SEQ ID NO: 600755 - DNA, 498 bp, Homo sapiens
  misc_feature: HIJSMM301EPYAR.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccaaggtgaccgtcctacgtcagcccaaggctgccccctcggtcactctcg

SEQ ID NO: 600756 - DNA, 444 bp, Homo sapiens; identical to SEQ ID NO: 534993
  misc_feature: HIJSMM301DV8GL.5.9.A09.1.454.light.4.raw

SEQ ID NO: 600757 - DNA, 486 bp, Homo sapiens; identical to SEQ ID NO: 537310
  misc_feature: HIJSMM301DJIUS.15.28.C06.1.454.light.4.raw

SEQ ID NO: 600758 - DNA, 498 bp, Homo sapiens
  misc_feature: HIJSMM301CN5R8.5.40.D07.1.454.light.4.raw
atcagacacgcacgaccggtgctcgatttagtgatagagcgtaacaacagaggggggaactgctcagttaggacccagacggaaccatggaagccccagcgcagcttctcttcctcctgctactctggctcccagataccattggagagatagtgatgacgcagtctccagccaccctgtctgtgtctccaggggaaagagcccaccctctcctgcagggccagccagagtgtaagtagtaggttagcctggtatcagcagaaacctggccaggctcccaggcctcctcatctatggtgcatctaccagggccactggtatcccagccaggttcagtggcagtgggtctgggacagagttcactctcaccatcagcagcctgcagtctgaagattttgctagtttattactgtcaacagtataatgactggtggacgttcggccaagggaccgaaggtaggaggaaccaaacgaaactgtggctgcaccactctcgtt

SEQ ID NO: 600759 - DNA, 500 bp, Homo sapiens
  misc_feature: HIJSMM301ED260.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaacgcccccaaactcatgatttatgaggtcacaaagcggccctcaggggtccctgatcgcttctctgcctccaagtctggcaacacggcctccctgaccgtctctgggctccagcctgaggatggaggctgattattactgcagctcatatgcaggcatcaacactgttttcggcggagggaccaagctgaccgtcctaggtcagcccaaggctgccccctcggtccactctgttccccaccctcctcgagtgcgtct

SEQ ID NO: 600760 - DNA, 502 bp, Homo sapiens
  misc_feature: HIJSMM301AOWNQ.9.27.C05.1.454.light.4.raw
tgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaagagccaccctctcctgtcgggccagtcagagtgttagaagcaacttagcctggtaccaacagagacctggccagcctcccaggctcctcatctttgatgcatccactagggccagtggaatcccagacaggttcagtggcagtgggtctgggacagagttcactctcagcatcaacagcgtgcgggctgaagtattttgttttttattattgtcagcagtatgataactggcctctgtggacgttcggccaagggaccaaggtggatgtacaaacgaactgtggctgcaccatctgtcttcatt

SEQ ID NO: 600761 - DNA, 513 bp, Homo sapiens
  misc_feature: HIJSMM301CNBTQ.15.76.G10.1.454.light.4.raw
tctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctggtcactctgttcccaccctcctcgctacg

SEQ ID NO: 600762 - DNA, 511 bp, Homo sapiens; identical to SEQ ID NO: 548439
  misc_feature: HIJSMM301EDK2G.16.46.E02.1.454.light.4.raw

SEQ ID NO: 600763 - DNA, 485 bp, Homo sapiens
  misc_feature: HIJSMM301CFCMX.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatccacttttggccaagggaccaagctggagatcaaacgaactgtggctgc

SEQ ID NO: 600764 - DNA, 496 bp, Homo sapiens
  misc_feature: HIJSMM301A5ELQ.16.53.E09.1.454.light.4.raw
  modified_base (362)..(362): a, c, t, g, unknown or other
  modified_base (369)..(369): a, c, t, g, unknown or other
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatnacccggnacagattttacactgaaaatcagcagagtggaggctgaggatgttggggtttattactgcatgcaagctctacaaactccttacacttttggccaggggaccaagctggagatcaaacgaactgtgg

SEQ ID NO: 600765 - DNA, 486 bp, Homo sapiens; identical to SEQ ID NO: 561506
  misc_feature: HIJSMM301AVXST.4.57.F02.1.454.light.4.raw

SEQ ID NO: 600766 - DNA, 500 bp, Homo sapiens
  misc_feature: HIJSMM301AJQAX.43.34.D01.1.454.light.4.raw
tgtgagtagtcacgaccggtgctcgatttagatcgtctgtgttggggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacactttatgtcttcggaattgggacgacggtcaccgtcctaggtcagcccaaggccaacccca

SEQ ID NO: 600767 - DNA, 497 bp, Homo sapiens; identical to SEQ ID NO: 535740
  misc_feature: HIJSMM301BEF2L.3.71.G05.1.454.light.4.raw

SEQ ID NO: 600768 - DNA, 463 bp, Homo sapiens; identical to SEQ ID NO: 535062
  misc_feature: HIJSMM301DJLBY.11.73.G07.1.454.light.4.raw

SEQ ID NO: 600769 - DNA, 487 bp, Homo sapiens; identical to SEQ ID NO: 536025
  misc_feature: HIJSMM301DDWS5.17.34.D01.1.454.light.4.raw

SEQ ID NO: 600770 - DNA, 496 bp, Homo sapiens
  misc_feature: HIJSMM301AWQOQ.16.46.E02.1.454.light.4.raw
tgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattatactgcagcttatatacaggcaacaatacttttgtcttcggaactgggaccaaggtcaccgtcctaggtcagcccaaggccaaccccactgtcactctgttcccaccctcctcgagtagtaca

SEQ ID NO: 600771 - DNA, 502 bp, Homo sapiens
  misc_feature: HIJSMM301D451S.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtccctcgaggttcagtggcagtggatctgggacacatttcaccctcacccatcaatagcctggaagctgaagatgctgcaacttattactgtcatcagagtactactttacctcaagtgatcaccttcggccaaggacacgactggagattaaacg

SEQ ID NO: 600772 - DNA, 484 bp, Homo sapiens
  misc_feature: HIJSMM301EHAMO.52.12.B01.1.454.light.4.raw
  modified_base (432)..(432): a, c, t, g, unknown or other
  modified_base (438)..(438): a, c, t, g, unknown or other
cgcagtacgacacgaccggtgctcgatttagtagtgtagattccgcggggctgagcctcaggaagcagcatcggaggtgcctcagccatggcatggatccctctcttcctcggcgtccttgcttactgcacaggatccgtggcctcctatgagttgactcagccaccctcagtgtccgtgtccccaggacagacagccagcatcacctgctctggagataaattgggggataaatatgtttcctggtatcagcagaagccaggccagtcccctgcgttggtcatctatcaagataccaagaggcgctcagggatccctgagcgattctctggctccaactctggggacacagccactctgaccatcagcgggacccagactctggatgaggctgactattactgtcaggcgtgggacagcagcacgggggtnttcggnggagggaccaagctgaccgtctaggtcagcccaaggctgccccctc

SEQ ID NO: 600773 - DNA, 511 bp, Homo sapiens; identical to SEQ ID NO: 549837
  misc_feature: HIJSMM301DK3WB.15.34.D01.1.454.light.4.raw

SEQ ID NO: 600774 - DNA, 485 bp, Homo sapiens; identical to SEQ ID NO: 536630
  misc_feature: HIJSMM301B08MJ.13.56.F01.1.454.light.4.raw

SEQ ID NO: 600775 - DNA, 517 bp, Homo sapiens
  misc_feature: HIJSMM301ASLPE.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcgacaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtcccgtggacgttcggcaagggaccaaggtggcaatcaaccgaactgtggctgcaccatctgtcttctatcttccccg

SEQ ID NO: 600776 - DNA, 492 bp, Homo sapiens
  misc_feature: HIJSMM301D8JFA.41.53.E09.1.454.light.4.raw
tctatactatcacgaccggtgctcgatttagagagagtgtgttggttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcagggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagcccaa

SEQ ID NO: 600777 - DNA, 485 bp, Homo sapiens
  misc_feature: HIJSMM301BWX3G.5.55.E11.1.454.light.4.raw
atcagacacgcacgaccggtgctcgatttagcactcgcacgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacaatttcaacagtaagaactacttagcttggtaccagcagaaaccaggacagcctcctaggctgctcatttactgggcatctacccgggaatccggggtccctgaccgattcagtggcagcggctctgggacagatttcactctcaccatcagcagcctgcaggctgaagatgtggcagtttattactgtcagcaatattttattactcctctgacgttcggccaagggaccaaggtggaaatcaaacga

SEQ ID NO: 600778 - DNA, 492 bp, Homo sapiens
  misc_feature: HIJSMM301BH0G8.13.56.F01.1.454.light.4.raw
tcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaagagccaccctctcctgcagggccagtcagacagttagcaacaacgtagcctggtaccagcagaaacgtggccaggctcccaggctcctcatctatggtgcatccaccagggccactggtatcccagaccggttcagtggcagtgggtctgggacagacttcactctcaccatcagcagtctgcagtctgaagatttgcagtttattactgtcagcagtataataactggcctccgtacatgtacacttttggccaggggaccaacctggagatcagacgaa

SEQ ID NO: 600779 - DNA, 507 bp, Homo sapiens
  misc_feature: HIJSMM301AFV1J.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcgggcggggggaccaagctgaccgtcctaggtcagcccaaggctgcccccc

SEQ ID NO: 600780 - DNA, 470 bp, Homo sapiens
  misc_feature: HIJSMM301DP7JQ.13.3.A03.1.454.light.4.raw
tcacgtactacacgaccggtgctcgatttagagagcgtcacagagaggaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaagcccctaagctcttgatctatggtgcatccagtttaaaaagtggggtcccatcaaggttcagcggcagtggatctggcacagacttcattctcaccatcagcagcctgcagcctgaagtatttgcaacttattactgtctacaagatcacaattatcctgggacgtcggccaagggacaaggtgaaatcaaacgaa

SEQ ID NO: 600781 - DNA, 491 bp, Homo sapiens; identical to SEQ ID NO: 535194
  misc_feature: HIJSMM301ADXF4.26.78.H01.1.454.light.4.raw

SEQ ID NO: 600782 - DNA, 503 bp, Homo sapiens
  misc_feature: HIJSMM301B8AXS.40.55.E11.1.454.light.4.raw
tctagcgactcacgaccggtgctcgatttagcactcgcacgttgggtttgggggggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatgtgggggtgccacttgggtgttcggcggagggaccaagctgaccgtcctaggtcagcccaaggctgccccctc

SEQ ID NO: 600783 - DNA, 490 bp, Homo sapiens; identical to SEQ ID NO: 535526
  misc_feature: HIJSMM301A1WYM.26.78.H01.1.454.light.4.raw

SEQ ID NO: 600784 - DNA, 444 bp, Homo sapiens
  misc_feature: HIJSMM301D7J51.8.11.A11.1.454.light.4.raw
ctcgcgtgtccacgaccggtgctcgatttagctacgactgcagggtcctgggcccagtccgtgctgacgcagccgccctcagtgtctggggccccaggccagagggtcgccatctcctgcactgggaacaactccaacatcggggcaggtcatgatgtacattggtaccagcagtttccaggaaaagcccccggactcctcatttttgttaacaacgatcgcccctcaggggtccctgaccgcttctctggctccaggtctggcgcctctgcctccctggccatcgctgggctccaccttgacgatgagggtttttattactgccagtcgtacgacgacagtctgactgccccggtgttcggcggcgggaccaaggtgaccgtcctgagtcagcccaaggctgcccccaggtcactctgttccccaccctcctcgacacgcgag

SEQ ID NO: 600785 - DNA, 514 bp, Homo sapiens
  misc_feature: HIJSMM301C8LTV.10.43.D10.1.454.light.4.raw
catagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtcggccgtccgggggcccactttcggcccgttcgggaccgaaagtggaatatctaaacgaaactgtggctgcaccactctgtcttctatt

SEQ ID NO: 600786 - DNA, 493 bp, Homo sapiens; identical to SEQ ID NO: 535657
  misc_feature: HIJSMM301C813E.27.78.H01.1.454.light.4.raw

SEQ ID NO: 600787 - DNA, 482 bp, Homo sapiens; identical to SEQ ID NO: 593228
  misc_feature: HIJSMM301CC8AX.3.14.B03.1.454.light.4.raw

SEQ ID NO: 600788 - DNA, 490 bp, Homo sapiens
  misc_feature: HIJSMM301ESRXK.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagattacaattaccctcggacgtcggtccagggaccgaacggtggaaatctaaacgaactagtggctgcacca

SEQ ID NO: 600789 - DNA, 467 bp, Homo sapiens
  misc_feature: HIJSMM301B3LE4.11.70.G04.1.454.light.4.raw
cgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgttgcaacttattaactgtcaaaaagataagcgctgccccgctcagtttcggcggagggaccaaaggtggagata

SEQ ID NO: 600790 - DNA, 482 bp, Homo sapiens; identical to SEQ ID NO: 544159
  misc_feature: HIJSMM301BTM3K.4.74.G08.1.454.light.4.raw

SEQ ID NO: 600791 - DNA, 485 bp, Homo sapiens
  misc_feature: HIJSMM301BEM5X.40.69.G03.1.454.light.4.raw
tctagcgactcacgaccggtgctcgatttagtcgctgcgtaaaggagaaagggggaggaactgctcagttaggacccagacggaaccatggaagccccagcgcagcttctcttcctcctgctactctggctcccagatagcgctggagaaatagtgatgacgcagtctccagccaccctgtctgtgtctccagggaaaagagccaccctctcctgcagggccagtgagagtgttgacacctacttagcctggtaccaacacagacctggccaggctcccaggctcctcatctctggtgcatccacccgggccactggtatcccagtcaggttcagtggcagtgggtctgggacagagttcactctcaccatcagcagcctgcagtctgaagatgttgcagtttattcctgtcagcagtacaatgactggccgtacacttttggccaggggaccaagctggagatacaaacgaactgtggctgcac

SEQ ID NO: 600792 - DNA, 491 bp, Homo sapiens; identical to SEQ ID NO: 536211
  misc_feature: HIJSMM301CS7R7.16.53.E09.1.454.light.4.raw

SEQ ID NO: 600793 - DNA, 484 bp, Homo sapiens; identical to SEQ ID NO: 535441
  misc_feature: HIJSMM301C5H4I.26.60.F05.1.454.light.4.raw

SEQ ID NO: 600794 - DNA, 500 bp, Homo sapiens
  misc_feature: HIJSMM301EDVEK.41.38.D05.1.454.light.4.raw
tctatactatcacgaccggtgctcgatttagtatctgatagttgggtttgggggccagacccagtcaggacacagcatggacatgagggtccccgctcagctcctggggctcctgctgctctggttcccaggttccagatgcgacatccagatgacccagtctccatcttctgtgtctgcatctgtcggagacagagtcaccatcacttgtcgggcgagtcagggtattggcagctacttagtctggtatcaacaaaaaccagggaaagcccctaaactccttatttatggatcatccagtttacaaagtggggtcccatcaaggttcagcggcagtggatctgggacacatttcactctcactatcagcagcctgcagcctgaggattttgcgacttactattgtcaacaggctgacagtttccctctcactttcggcggagggaccaaggttgagaccaaacgaactgtggctgcaccatctgtcttcatcttccccg

SEQ ID NO: 600795 - DNA, 482 bp, Homo sapiens; identical to SEQ ID NO: 562591
  misc_feature: HIJSMM301A24V2.49.83.H06.1.454.light.4.raw

SEQ ID NO: 600796 - DNA, 503 bp, Homo sapiens
  misc_feature: HIJSMM301BQ7FX.10.39.D06.1.454.light.4.raw
catagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccggccctcagggatccctgagcgattctctggctccaattcgggcaacacggccaccctcatcatcaccagggtcgaggccggggatgaggccgactactactgccaggtgtgggatttcactactgatcatgtgggggtcttcggcggagggaccaagctgaccgtcctaagtcagcccaaggctgccccctcggtca

SEQ ID NO: 600797 - DNA, 490 bp, Homo sapiens; identical to SEQ ID NO: 535234
  misc_feature: HIJSMM301CB0RY.17.21.B10.1.454.light.4.raw

SEQ ID NO: 600798 - DNA, 501 bp, Homo sapiens
  misc_feature: HIJSMM301CYLYS.15.37.D04.1.454.light.4.raw
tctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttgccgggccagtcaaaatattactaggtggttggcctggtatcagcagaaaccagggaaggcccctaagtccctcatcaagaaggcgtctactttagaagctggggtcccgtcaagattcagcgccggtggatctgggacagaattcactctcaccatcaacagcctggaacctgatgattttgcaacttattactgccaacactatgatactcacccgtacacttttggccaggggaccaagctggagatcaaaggaactgtggctgcaccatctgtcttcatccttccg

SEQ ID NO: 600799 - DNA, 499 bp, Homo sapiens
  misc_feature: HIJSMM301DW4U0.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccggtcctaggtcagcccaaggccaaccc

SEQ ID NO: 600800 - DNA, 499 bp, Homo sapiens
  misc_feature: HIJSMM301EUI5V.43.60.F05.1.454.light.4.raw
tgtgagtagtcacgaccggtgctcgatttagtacgtcatcagggaaagggggcaggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttacccccggacgttcgcctacgggaccgacggtcggacgtggtcgtaagcgaacgtagtaggcgtgcgaccact

SEQ ID NO: 600801 - DNA, 481 bp, Homo sapiens; identical to SEQ ID NO: 535993
  misc_feature: HIJSMM301ADFH4.21.25.C03.1.454.light.4.raw

SEQ ID NO: 600802 - DNA, 517 bp, Homo sapiens; identical to SEQ ID NO: 541955
  misc_feature: HIJSMM301EAUJO.22.30.C08.1.454.light.4.raw

SEQ ID NO: 600803 - DNA, 502 bp, Homo sapiens
  misc_feature: HIJSMM301D82BE.43.14.B03.1.454.light.4.raw
tgtgagtagtcacgaccggtgctcgatttagtgtgagtagttccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcacttatgtcttcggaactgggaccaaggtcaccgacctaggtcagcccaaggccaacccactgtca

SEQ ID NO: 600804 - DNA, 479 bp, Homo sapiens; identical to SEQ ID NO: 538734
  misc_feature: HIJSMM301A9115.8.53.E09.1.454.light.4.raw

SEQ ID NO: 600805 - DNA, 479 bp, Homo sapiens
  misc_feature: HIJSMM301BNBEL.3.38.D05.1.454.light.4.raw
  modified_base (101)..(101): a, c, t, g, unknown or other
agacgcactccacgaccggtgctcgatttagtatctgatagttgggtttgggggcaggagtcagtctcagtcaggacacagcatggacatgagggtccccnctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccaagggaaagcccctaagctcctgatctatgctgcatccagtttgcaaaagtggggtcccatcaaggttcagtggcagtggatctgggacagatttcactctcaccatcaacagtctgcaacctgaagattttgcaaacttactactgtcaaacagagttttcactacccctctcactttcggcggggggacgaaagtggagatacaaacaaa

SEQ ID NO: 600806 - DNA, 447 bp, Homo sapiens
  misc_feature: HIJSMM301AYSYE.14.76.G10.1.454.light.4.raw
cgtctagtaccacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctcgccccctcggtcactctcgttccccaccctcctcgtactagacg

SEQ ID NO: 600807 - DNA, 500 bp, Homo sapiens
  misc_feature: HIJSMM301DKD98.12.86.H09.1.454.light.4.raw
atacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgaagattttgctagtttattactgtcagcagcgtagcaactggcctcggttcacttttggccaggggaccaagctggagatcaaacgaactgtggctgcaccatctgtcttcatt

SEQ ID NO: 600808 - DNA, 485 bp, Homo sapiens; identical to SEQ ID NO: 536040
  misc_feature: HIJSMM301BI59V.15.1.A01.1.454.light.4.raw

SEQ ID NO: 600809 - DNA, 486 bp, Homo sapiens; identical to SEQ ID NO: 535458
  misc_feature: HIJSMM301DA343.7.75.G09.1.454.light.4.raw

SEQ ID NO: 600810 - DNA, 488 bp, Homo sapiens; identical to SEQ ID NO: 564814
  misc_feature: HIJSMM301DB4T4.14.55.E11.1.454.light.4.raw

SEQ ID NO: 600811 - DNA, 482 bp, Homo sapiens
  misc_feature: HIJSMM301D620G.8.53.E09.1.454.light.4.raw
ctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagccccccagactcctcattaatgaataacaacaatcggccctcagggtctctgaccgattctctgcctccaagtctggcacttctgcctccctggtcatatctggtctccagggtgaggatgaggctgatttattactgccactcctatgacaacagcctgagtatttggctgttcggcggcgggacc

SEQ ID NO: 600812 - DNA, 488 bp, Homo sapiens
  misc_feature: HIJSMM301D6D22.4.34.D01.1.454.light.4.raw
agcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggctcctcatctatggtgcatccaccagggccactggtatcccagccaggttcagtggcagtgggtctgggacagacttcactctcaccatcagcagactggagcctgaagattttgcagtgtattactgtcagcagtgtggtagctcaccgacgttcggccaagggaccgaaggtggaaatacaaacgaactagtggctgcaccatct

SEQ ID NO: 600813 - DNA, 435 bp, Homo sapiens; identical to SEQ ID NO: 592291
  misc_feature: HIJSMM301CEGSX.18.5.A05.1.454.light.4.raw

SEQ ID NO: 600814 - DNA, 502 bp, Homo sapiens
  misc_feature: HIJSMM301BO88R.2.76.G10.1.454.light.4.raw
acgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgacccccaaactcctcatctctcacaataatcagcggccctcaggagtccctgaccgattctctgcctccaagtccggcacctcagcctccctggccatcagtgggctccgggccgaggatgaggctgattattactgtgcaggatgggatgacaaccgtggtgcttatctcttcggacctgggaccaaggtcaccgtcttggt

SEQ ID NO: 600815 - DNA, 485 bp, Homo sapiens; identical to SEQ ID NO: 536040
  misc_feature: HIJSMM301DKVZW.15.1.A01.1.454.light.4.raw

SEQ ID NO: 600816 - DNA, 509 bp, Homo sapiens
  misc_feature: HIJSMM301EBNEQ.3.37.D04.1.454.light.4.raw
agacgcactccacgaccggtgctcgatttagtagcatactgttgggtttggggggggtcgtcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccagcagtgacgttggtagatataattatgtctcctggtaccaacaactcccaggcaaagtccccaaactgatgatttatgatgtcaataatcggccctcaggggtttctaatcgcttctctggctccaagtctggcaacacggcctccctgaccatctctgggctccagggtgaggacgaggctgattattactgcagctcatttacaagcagcaccactcaggtcttcggaactgggactaaggtcaccgtcctaggtcagcccaaggccaaccccactgtcact

SEQ ID NO: 600817 - DNA, 513 bp, Homo sapiens
  misc_feature: HIJSMM301AP4ZZ.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccgaagactgaccgtcctgggtcagcccaacggctgccccctccggtcacctctcgttcccaccctccctcctacgtcgtat

SEQ ID NO: 600818 - DNA, 447 bp, Homo sapiens; identical to SEQ ID NO: 535020
  misc_feature: HIJSMM301DSV8E.18.9.A09.1.454.light.4.raw

SEQ ID NO: 600819 - DNA, 454 bp, Homo sapiens; identical to SEQ ID NO: 536943
  misc_feature: HIJSMM301C0FEF.19.86.H09.1.454.light.4.raw

SEQ ID NO: 600820 - DNA, 488 bp, Homo sapiens
  misc_feature: HIJSMM301B1ZVO.17.55.E11.1.454.light.4.raw
cgtagactagcacgaccggtgctcgatttagcactcgcacgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacagtaagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctctcactttcggcggagggaccgaaaggtggagatcaaacgaa

SEQ ID NO: 600821 - DNA, 481 bp, Homo sapiens; identical to SEQ ID NO: 545581
  misc_feature: HIJSMM301DAOGA.48.19.B08.1.454.light.4.raw

SEQ ID NO: 600822 - DNA, 516 bp, Homo sapiens
  misc_feature: HIJSMM301AEGOE.40.33.C11.1.454.light.4.raw
tctagcgactcacgaccggtgctcgatttagagtgagctcgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccagttacgggggcccagccagaggatgagtcttattattactgcatgctccatggtggggggtgccgacgttgggtgttcgggcggagggaccaagctgaccgtccg

SEQ ID NO: 600823 - DNA, 486 bp, Homo sapiens
  misc_feature: HIJSMM301EE8JB.11.11.A11.1.454.light.4.raw
  modified_base (453)..(453): a, c, t, g, unknown or other
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggacagcctcctaaactgctcatctcctgggcatctacccgggcacccggagtccctgaccgattcagtggcagcgggtctgggacagacttcactctcaccatcagcaacctgcaggctgaagatgtggcagtttattactgtcagcagtattgtgaagcttccgctcactttcgggcggaggggtaccggcggtggganatcagacgaactggtggctgcaccatctgtctt

SEQ ID NO: 600824 - DNA, 490 bp, Homo sapiens; identical to SEQ ID NO: 535420
  misc_feature: HIJSMM301DA0LR.3.72.G06.1.454.light.4.raw

SEQ ID NO: 600825 - DNA, 495 bp, Homo sapiens
  misc_feature: HIJSMM301BST8I.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacaggaattcactctcaccatcaccagcctgcagtctgaagattttgcagtctattactgtcagcaatataattactggctctctttcggcgggggaccaagctggagatcaaccgaactgtggctgcaccatctgtt

SEQ ID NO: 600826 - DNA, 516 bp, Homo sapiens
  misc_feature: HIJSMM301BCS4K.41.53.E09.1.454.light.4.raw
tctatactatcacgaccggtgctcgatttagagagagtgtgttgggtttgggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggtttctggctccatcgacagtccctccaactccgcctcccttaccatatctgggctgaagagtgaggacgaggctgactacttctgtcagtcttatgatataaacattatgtgataattggcggagggaccagggtgaccgtcctaggtcagcccaaggctgccccctcggtcactttgttcccg

SEQ ID NO: 600827 - DNA, 487 bp, Homo sapiens
  misc_feature: HIJSMM301CB9OD.49.33.C11.1.454.light.4.raw
  modified_base (417)..(417): a, c, t, g, unknown or other
agtcgagagacacgaccggtgctcgatttagagtgagctcgttgggtttggggggaactgctcagttaggacccagacggaaccatggaagctccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtanaatgtccgggctccggacactttcggcggagggaccaaggtggagatcaaacgaactgtggctgcaccat

SEQ ID NO: 600828 - DNA, 495 bp, Homo sapiens; identical to SEQ ID NO: 535821
  misc_feature: HIJSMM301BTYOH.3.31.C09.1.454.light.4.raw

SEQ ID NO: 600829 - DNA, 486 bp, Homo sapiens; identical to SEQ ID NO: 535043
  misc_feature: HIJSMM301B4SAB.46.35.D02.1.454.light.4.raw

SEQ ID NO: 600830 - DNA, 509 bp, Homo sapiens; identical to SEQ ID NO: 539359
  misc_feature: HIJSMM301AZNQD.47.85.H08.1.454.light.4.raw

SEQ ID NO: 600831 - DNA, 503 bp, Homo sapiens; identical to SEQ ID NO: 539976
  misc_feature: HIJSMM301D5BH7.47.55.E11.1.454.light.4.raw

SEQ ID NO: 600832 - DNA, 508 bp, Homo sapiens; identical to SEQ ID NO: 549157
  misc_feature: HIJSMM301BS9W7.17.33.C11.1.454.light.4.raw

SEQ ID NO: 600833 - DNA, 486 bp, Homo sapiens; identical to SEQ ID NO: 535043
  misc_feature: HIJSMM301BVENQ.46.35.D02.1.454.light.4.raw

SEQ ID NO: 600834 - DNA, 500 bp, Homo sapiens; identical to SEQ ID NO: 550395
  misc_feature: HIJSMM301A51HJ.15.56.F01.1.454.light.4.raw

SEQ ID NO: 600835 - DNA, 489 bp, Homo sapiens; identical to SEQ ID NO: 536013
  misc_feature: HIJSMM301DG93Y.26.23.C01.1.454.light.4.raw

SEQ ID NO: 600836 - DNA, 487 bp, Homo sapiens
  misc_feature: HIJSMM301AOMQ0.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctggcaggttcagtggcagtggatcagacacagattttacactgaaaatcagtagagtggaggctgaggatgttggagtttattactgcatgcaagctctacaaactcctctcactttcggcggagggaccaaggtggagatcaaacgaactgt

SEQ ID NO: 600837 - DNA, 505 bp, Homo sapiens
  misc_feature: HIJSMM301C03HH.47.83.H06.1.454.light.4.raw
agctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctggggtccctgatcgcttctctggttccatccttgggaacaaagctgccctcaccatcgcggggcccaggcagatgatgagtgtgattattactgtgtgctctatatgggcagtggcgtttgggtgttcggcggagggaccaagctgaccgtcg

SEQ ID NO: 600838 - DNA, 486 bp, Homo sapiens; identical to SEQ ID NO: 537583
  misc_feature: HIJSMM301D1DC3.17.25.C03.1.454.light.4.raw

SEQ ID NO: 600839 - DNA, 463 bp, Homo sapiens; identical to SEQ ID NO: 535062
  misc_feature: HIJSMM301CFESD.11.73.G07.1.454.light.4.raw

SEQ ID NO: 600840 - DNA, 489 bp, Homo sapiens; identical to SEQ ID NO: 558406
  misc_feature: HIJSMM301A1W7I.19.15.B04.1.454.light.4.raw

SEQ ID NO: 600841 - DNA, 495 bp, Homo sapiens; identical to SEQ ID NO: 535964
  misc_feature: HIJSMM301AUO11.16.10.A10.1.454.light.4.raw

SEQ ID NO: 600842 - DNA, 492 bp, Homo sapiens; identical to SEQ ID NO: 539815
  misc_feature: HIJSMM301CNYUK.51.81.H04.1.454.light.4.raw

SEQ ID NO: 600843 - DNA, 484 bp, Homo sapiens; identical to SEQ ID NO: 535400
  misc_feature: HIJSMM301DFOV6.46.26.C04.1.454.light.4.raw

SEQ ID NO: 600844 - DNA, 464 bp, Homo sapiens
  misc_feature: HIJSMM301B50F7.11.73.G07.1.454.light.4.raw
  modified_base (410)..(410): a, c, t, g, unknown or other
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccaccgaggttcagtggaagtggatctgggacagactttactctcaccatcagcagcctgcagcctgaagatattgcaacatattactgtcaacngtatgatcgtctcctcaatttcggccctgggaccagacgtggacatgaaacgaa

SEQ ID NO: 600845 - DNA, 495 bp, Homo sapiens
  misc_feature: HIJSMM301BP9OP.48.70.G04.1.454.light.4.raw
  modified_base (376)..(376): a, c, t, g, unknown or other
  modified_base (405)..(405): a, c, t, g, unknown or other
  modified_base (439)..(439): a, c, t, g, unknown or other
agtatacatacacgaccggtgctcgatttagtgtagtgtgaagggaaagggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttacnctcaccatcagtagcctgcaggctgaagntgtggcagtttatactgtcaacaattattattanactccgcgacgttcggccggggacaacgtggaaatcaaacgaactgtaggctgcac

SEQ ID NO: 600846 - DNA, 521 bp, Homo sapiens
  misc_feature: HIJSMM301EWMRQ.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcacgcagcactctaagtcttcggtaactacgggtaccgaacggtacgaccgtaccgtacggttacgacgacccgaacggaccgaaa

SEQ ID NO: 600847 - DNA, 497 bp, Homo sapiens; identical to SEQ ID NO: 536371
  misc_feature: HIJSMM301BHRV6.16.78.H01.1.454.light.4.raw

SEQ ID NO: 600848 - DNA, 500 bp, Homo sapiens
  misc_feature: HIJSMM301AOQX4.40.57.F02.1.454.light.4.raw
tctagcgactcacgaccggtgctcgatttagctcgatatagttggggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttatttttgtctgctcttatgcaggcagtttcgctctcgaagtgttcggcggagggaccgagctgaccgtcctacgtcagcccaaggctcg

SEQ ID NO: 600849 - DNA, 523 bp, Homo sapiens
  misc_feature: HIJSMM301BE929.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggtcggagggaccaggctgaccgtcctaggtcagcccaaggctgccccctcggtcactctcgttcccaccct

SEQ ID NO: 600850 - DNA, 494 bp, Homo sapiens; identical to SEQ ID NO: 535276
  misc_feature: HIJSMM301DTS93.16.6.A06.1.454.light.4.raw

SEQ ID NO: 600851 - DNA, 504 bp, Homo sapiens; identical to SEQ ID NO: 540538
  misc_feature: HIJSMM301C6409.7.71.G05.1.454.light.4.raw

SEQ ID NO: 600852 - DNA, 512 bp, Homo sapiens
  misc_feature: HIJSMM301A64V2.41.53.E09.1.454.light.4.raw
tctatactatcacgaccggtgctcgatttagagagagtgtgttgggtttggggggggtctcaggaggcagcgctctcgggacgtctccaccatggcctgggctctgctattcctcaccctcctcactcagggcacagggccctgggcccagtctgccctgactcagcctgcctccgtgtctgggtctcctggacagtcgattaccatctcctgctctgggatcaacagcgaccttggtggttataactatgtgtcctggtaccaacaatatccaggcaaacccccaaagtcatcatttatgatgtcggtagtcggccctccggggtctctagtcgcttctctggctccaagtctggcaacacggcctccctgaccatctctgggctccaggctgaggacgaggctgactattactgcagttcatatacaagcagcagcactggagtcttcggaactgggaccagggtcaccgtcctaggtcagcccaaggcccaacccactgtcactcttcg

SEQ ID NO: 600853 - DNA, 494 bp, Homo sapiens; identical to SEQ ID NO: 534994
  misc_feature: HIJSMM301CQPM0.27.78.H01.1.454.light.4.raw

SEQ ID NO: 600854 - DNA, 501 bp, Homo sapiens; identical to SEQ ID NO: 536142
  misc_feature: HIJSMM301CYK6T.15.1.A01.1.454.light.4.raw

SEQ ID NO: 600855 - DNA, 508 bp, Homo sapiens
  misc_feature: HIJSMM301AUUOD.10.27.C05.1.454.light.4.raw
catagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggtaacacggcctccctgacaatctctgggctccaggctgacgacgaggctgaatattactgcagctcatatgtagatggtgcctctttcaaggttttcggcggagggaccaggctgaccgtcctaagtcagcccaaggctgccccctcggtca

SEQ ID NO: 600856 - DNA, 444 bp, Homo sapiens; identical to SEQ ID NO: 535192
  misc_feature: HIJSMM301AJRU9.5.9.A09.1.454.light.4.raw

SEQ ID NO: 600857 - DNA, 464 bp, Homo sapiens
  misc_feature: HIJSMM301ELZ0R.40.10.A10.1.454.light.4.raw
tctagcgactcacgaccggtgctcgatttagcgtcgatctcagggggcaggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggccagggaccaaagtggatgtcaaccgaa

SEQ ID NO: 600858 - DNA, 460 bp, Homo sapiens; identical to SEQ ID NO: 539553
  misc_feature: HIJSMM301EDVHQ.11.86.H09.1.454.light.4.raw

SEQ ID NO: 600859 - DNA, 498 bp, Homo sapiens
  misc_feature: HIJSMM301D97M8.22.27.C05.1.454.light.4.raw
acatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggctagtttattactgtcagcaatattatattcctcctcagacgttcggccaagggaccaaggtggaaatcaaacgaactgtgctgcaccat

SEQ ID NO: 600860 - DNA, 510 bp, Homo sapiens
  misc_feature: HIJSMM301B0TBB.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggccgtccgggggccactttccggcccgtcgggaccaaaggtggatatcaaacgaactgtggctgcaccatctgtctt

SEQ ID NO: 600861 - DNA, 501 bp, Homo sapiens
  misc_feature: HIJSMM301D3KCZ.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggaggaccaaggtgaccgtctaggtcagcccaaggctgcccccc

SEQ ID NO: 600862 - DNA, 495 bp, Homo sapiens; identical to SEQ ID NO: 546408
  misc_feature: HIJSMM301AY00T.41.28.C06.1.454.light.4.raw

SEQ ID NO: 600863 - DNA, 507 bp, Homo sapiens
  misc_feature: HIJSMM301CW5SR.48.36.D03.1.454.light.4.raw
agtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccgatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttcaagtttcctttttgtcttcggaactgggaccgaggtcaccgtcctaggtcagcccaaggccaaccccactcgtcta

SEQ ID NO: 600864 - DNA, 494 bp, Homo sapiens
  misc_feature: HIJSMM301D3FO4.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactgggctcaggcggaagatgaggctgactattactgtaactccgggacagcagtgctgaccaggtggtattcggcggagggaccacctgaccgtctaggtcagcccaaggctgccccctcgg

SEQ ID NO: 600865 - DNA, 520 bp, Homo sapiens
  misc_feature: HIJSMM301BNTZP.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaagctgaccgtcctaagtcagcccaaggctggccccctcggtccactctgttccccaccctccctccg

SEQ ID NO: 600866 - DNA, 484 bp, Homo sapiens; identical to SEQ ID NO: 535400
  misc_feature: HIJSMM301BB4XS.46.26.C04.1.454.light.4.raw

SEQ ID NO: 600867 - DNA, 497 bp, Homo sapiens; identical to SEQ ID NO: 536807
  misc_feature: HIJSMM301DTSN0.10.37.D04.1.454.light.4.raw

SEQ ID NO: 600868 - DNA, 494 bp, Homo sapiens; identical to SEQ ID NO: 534992
  misc_feature: HIJSMM301AWJGK.9.1.A01.1.454.light.4.raw

SEQ ID NO: 600869 - DNA, 488 bp, Homo sapiens
  misc_feature: HIJSMM301BLAT4.22.86.H09.1.454.light.4.raw
acatacgcgtcacgaccggtgctcgatttagtgctatagacttgggtttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtctaggtcagcccaa

SEQ ID NO: 600870 - DNA, 506 bp, Homo sapiens
  misc_feature: HIJSMM301D6DAX.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaatcatgatttatgatgtcactaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcta

SEQ ID NO: 600871 - DNA, 497 bp, Homo sapiens
  misc_feature: HIJSMM301ESHZX.11.59.F04.1.454.light.4.raw
cgagagataccacgaccggtgctcgatttagtacacacacttagggattggggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagcccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtcctaggtcagcccaaggccaaccccactgtcactctgttccccgccctcctcgtatcct

SEQ ID NO: 600872 - DNA, 492 bp, Homo sapiens
  misc_feature: HIJSMM301BHUFH.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgctaacttattttgtcaacaggctaacactttccccctcactttcggcggagggaccaaggtggagatcaagcgaactgtggctgcaccatctgtcttt

SEQ ID NO: 600873 - DNA, 477 bp, Homo sapiens
  misc_feature: HIJSMM301DRFJ2.16.86.H09.1.454.light.4.raw
tgtactactccacgaccggtgctcgatttagtgctatagacttgggtttggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctgccccctcggtcactctcgttcccaccctcctcgagtagtaca

SEQ ID NO: 600874 - DNA, 481 bp, Homo sapiens
  misc_feature: HIJSMM301BR7KF.41.17.B06.1.454.light.4.raw
tctatactatcacgaccggtgctcgatttagtcgatagtgaaggggggaactgctcagttaggacccagacggaaccatggaagccccagcgcagcttctcttcctcctgctactctggctcccagatatcacaggagagatagtgatgacgcagtctccagccaccctgtctctgtctccaggggaaagagcctccctctcctgcagggccagtcagaatattcgcggccacttagcctggtatcagcagaaacctggccaggctcccaggctcctcatctatgctgcatccaccagggccactggtatcccagccaggttcagtggcggtgggtctggggacagagtttactctcaccatcaacggcctgcagtctgaagattctgcagtttattactgtcagcagtatgttgactggcctccgctcactttcggcggagggaccaaggtggagatcagacgaactgtggctgcaccat

SEQ ID NO: 600875 - DNA, 508 bp, Homo sapiens; identical to SEQ ID NO: 550253
  misc_feature: HIJSMM301D0C0E.9.55.E11.1.454.light.4.raw

SEQ ID NO: 600876 - DNA, 497 bp, Homo sapiens; identical to SEQ ID NO: 545672
  misc_feature: HIJSMM301DBFZL.2.49.E05.1.454.light.4.raw

SEQ ID NO: 600877 - DNA, 494 bp, Homo sapiens; identical to SEQ ID NO: 557531
  misc_feature: HIJSMM301ANPXK.11.59.F04.1.454.light.4.raw

SEQ ID NO: 600878 - DNA, 489 bp, Homo sapiens
  misc_feature: HIJSMM301E01X4.12.12.B01.1.454.light.4.raw
atacgacgtacacgaccggtgctcgatttagtagtgtagattccgcggggacagcgaccatgttctgagggtcagactcaaacagcatcacccaggacaccgacaggagccggggcacaatgagagcctcacctgggaaatgcagccggaggcacctgggcccagatgtcagcctgggcagctcccacagtgctggaattccctggaagatgccccaaggttgagtctctgaggcctcctatgagctgacacagccaccctcggtgtcagtgtccccaggacaaacggccaggatcacctgctctggagctgcattgccaataaaatctccttattggtaccagcagaagtcaggccaggcccctgtattggtcatctatgaggacaacagacgaccttccgggatccctgagagattctctggctccacctcaggacaatggccaccttgactatcagtggcgcccaggtggaggatgaggctgacta

SEQ ID NO: 600879 - DNA, 478 bp, Homo sapiens; identical to SEQ ID NO: 535129
  misc_feature: HIJSMM301BG4U3.11.11.A11.1.454.light.4.raw

SEQ ID NO: 600880 - DNA, 496 bp, Homo sapiens; identical to SEQ ID NO: 536802
  misc_feature: HIJSMM301CXRVZ.5.24.C02.1.454.light.4.raw

SEQ ID NO: 600881 - DNA, 516 bp, Homo sapiens
  misc_feature: HIJSMM301ASDGM.40.42.D09.1.454.light.4.raw
tctagcgactcacgaccggtgctcgatttagacacatacgcagggaaaggggggcctaaggaagcagcactggtggtgcctcagccatggcctggaccgttctcctcctcggcctcctctctcactgcacagggtctgtgacctcctatgtgctgactcagccactctcggtgtctgtggccccaggacaggcggccaatgttacctgtgggggagacaacattgggagtaaaagtgtgcactggtaccagctgaagccaggccaggcccctgtgttggtcgtctttggacatggtgcccgaccctcggggatccctgagcgattctctgcctccaggtctgggaacacggccaccctgaccatcaccagggtcgaggccggagatgaggccgactattttgtcacgtgtggcacgttagtcatcacgtcttcggaactgggaccacggtcaccgtcctaagtcagcccaaggccaacccactgtcactctgttcccaccctcctcagtcgctaga

SEQ ID NO: 600882 - DNA, 516 bp, Homo sapiens
  misc_feature: HIJSMM301AGLEO.47.53.E09.1.454.light.4.raw
agctcacgtacacgaccggtgctcgatttagagagagtgtgttgggtttggggagtctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcggggatgaggccgtatattttgtcaggtgtgggagactaattttggtcatatgttgttcggcggagggaccaagctgaccgtcctcggtcagcccaaggctgccccctcggtcactctgttcccgccct

SEQ ID NO: 600883 - DNA, 489 bp, Homo sapiens
  misc_feature: HIJSMM301D3T4V.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagtgggctccagtctgaggactctgcaacttattactgccaacaatatgatatttattctccagcgttcggccaggggaccaaggtggaagtcaagcgaactgtggctgcaccatctgtt

SEQ ID NO: 600884 - DNA, 473 bp, Homo sapiens; identical to SEQ ID NO: 538875
  misc_feature: HIJSMM301CWOCP.4.75.G09.1.454.light.4.raw

SEQ ID NO: 600885 - DNA, 493 bp, Homo sapiens; identical to SEQ ID NO: 543949
  misc_feature: HIJSMM301D3CKX.16.68.G02.1.454.light.4.raw

SEQ ID NO: 600886 - DNA, 499 bp, Homo sapiens; identical to SEQ ID NO: 547044
  misc_feature: HIJSMM301BMDSG.43.71.G05.1.454.light.4.raw

SEQ ID NO: 600887 - DNA, 507 bp, Homo sapiens; identical to SEQ ID NO: 538063
  misc_feature: HIJSMM301BUG5X.47.85.H08.1.454.light.4.raw

SEQ ID NO: 600888 - DNA, 503 bp, Homo sapiens
  misc_feature: HIJSMM301BQ7G3.43.34.D01.1.454.light.4.raw
tgtgagtagtcacgaccggtgctcgatttagatcgtctgtgttggggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagtttacacttatgtcttcggaattgggacacggtcaccggtctaggtcagcccaaggcccaaccctac

SEQ ID NO: 600889 - DNA, 487 bp, Homo sapiens
  misc_feature: HIJSMM301EA9LL.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggccaaggaccgaaggtaggaaatacaaacgaactagtggctgcaccta

SEQ ID NO: 600890 - DNA, 510 bp, Homo sapiens
  misc_feature: HIJSMM301C9JR5.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctggcaccgatctgtcttcatcttcccgcc

SEQ ID NO: 600891 - DNA, 503 bp, Homo sapiens
  misc_feature: HIJSMM301BQWHK.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggtccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtcctaggtcagccaaggctcgcccccttc

SEQ ID NO: 600892 - DNA, 506 bp, Homo sapiens; identical to SEQ ID NO: 557726
  misc_feature: HIJSMM301CBG33.47.83.H06.1.454.light.4.raw

SEQ ID NO: 600893 - DNA, 499 bp, Homo sapiens
  misc_feature: HIJSMM301ESJE2.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccatcggtca

SEQ ID NO: 600894 - DNA, 487 bp, Homo sapiens; identical to SEQ ID NO: 554782
  misc_feature: HIJSMM301BH4G8.46.35.D02.1.454.light.4.raw

SEQ ID NO: 600895 - DNA, 489 bp, Homo sapiens
  misc_feature: HIJSMM301DF1DL.47.38.D05.1.454.light.4.raw
agctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggttattactgcatgcaagttctacaaacttcctacacttttggccaggggaccaagctggagatcaaacgaactgtgg

SEQ ID NO: 600896 - DNA, 495 bp, Homo sapiens
  misc_feature: HIJSMM301AW7EB.41.37.D04.1.454.light.4.raw
tctatactatcacgaccggtgctcgatttagtagcatactgttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagcccaa

SEQ ID NO: 600897 - DNA, 443 bp, Homo sapiens; identical to SEQ ID NO: 536127
  misc_feature: HIJSMM301C1ZL3.4.39.D06.1.454.light.4.raw

SEQ ID NO: 600898 - DNA, 489 bp, Homo sapiens
  misc_feature: HIJSMM301CL6HF.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaagaactgtggctgcaccatctgtcttcatt

SEQ ID NO: 600899 - DNA, 509 bp, Homo sapiens; identical to SEQ ID NO: 543772
  misc_feature: HIJSMM301BHLHV.2.21.B10.1.454.light.4.raw

SEQ ID NO: 600900 - DNA, 511 bp, Homo sapiens
  misc_feature: HIJSMM301DYMCN.40.11.A11.1.454.light.4.raw
tctagcgactcacgaccggtgctcgatttagctacgactgcagggggagctacaacaggcaggcaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcaccatcagcggcctgcaggctgaagatgtggcagtttattactgtcagcactgttttggcggttctccgactttcggcggagggaccgaacggtggaggtcaaacgaactgtggcgtgcacactctgtcttcattccc

SEQ ID NO: 600901 - DNA, 505 bp, Homo sapiens; identical to SEQ ID NO: 594680
  misc_feature: HIJSMM301A41CU.41.26.C04.1.454.light.4.raw

SEQ ID NO: 600902 - DNA, 521 bp, Homo sapiens; identical to SEQ ID NO: 539470
  misc_feature: HIJSMM301EKPUB.27.23.C01.1.454.light.4.raw

SEQ ID NO: 600903 - DNA, 493 bp, Homo sapiens; identical to SEQ ID NO: 535047
  misc_feature: HIJSMM301AS9I0.16.53.E09.1.454.light.4.raw

SEQ ID NO: 600904 - DNA, 495 bp, Homo sapiens; identical to SEQ ID NO: 537415
  misc_feature: HIJSMM301ENRQ7.4.27.C05.1.454.light.4.raw

SEQ ID NO: 600905 - DNA, 484 bp, Homo sapiens
  misc_feature: HIJSMM301CL3RP.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagccctaagctcctgatctacgatgcatccaatttggaaacaggggtcccatcaaggttcagtggaagtggatctgggacagtattttactttcaccatcagcagcctgcagcctgaagatattgcaacatattactgtcaacagtatcataatctcccactttcggccctggaccaaagtggatatcaaacgaactgtggctgcaccatctgtt

SEQ ID NO: 600906 - DNA, 493 bp, Homo sapiens
  misc_feature: HIJSMM301A487C.40.22.B11.1.454.light.4.raw
tctagcgactcacgaccggtgctcgatttagacgacagctcagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgaatagtaatggatacaactatttggattggtacctgcagaagccagggcagtgtccacagctcctgatctatttgggttctaatcgggcctccggggtccctgacaggttcagtggcagtggatcaggtacagattttacactgaaaatcagcagagtggaggctgaggatgttggggtttattactgcatgcaagctctacaaattcctcggacgttcggccaagggaccaaggtggaaatacaaacgaactagtggctgcaccat

SEQ ID NO: 600907 - DNA, 484 bp, Homo sapiens
  misc_feature: HIJSMM301AKVK0.43.60.F05.1.454.light.4.raw
tgtgagtagtcacgaccggtgctcgatttagtacgtcatcagggaaagggggcaggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggtccgacggggaccgacggtcggagtgtacaagacgaactagt

SEQ ID NO: 600908 - DNA, 494 bp, Homo sapiens; identical to SEQ ID NO: 534994
  misc_feature: HIJSMM301AHO10.27.78.H01.1.454.light.4.raw

SEQ ID NO: 600909 - DNA, 510 bp, Homo sapiens
  misc_feature: HIJSMM301EMYJ3.43.67.G01.1.454.light.4.raw
  modified_base (496)..(496): a, c, t, g, unknown or other
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagcccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggccggggaccaccgtaggaatacaaacgaactagtggcngcaccatctgtctt

SEQ ID NO: 600910 - DNA, 486 bp, Homo sapiens
  misc_feature: HIJSMM301B6FCK.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgaagattttgcagtttattactgtcagcactataataactggcctccgtacagttttggccaggggaccaagctggagatcaaacgaactgttg

SEQ ID NO: 600911 - DNA, 520 bp, Homo sapiens; identical to SEQ ID NO: 572049
  misc_feature: HIJSMM301EN190.27.23.C01.1.454.light.4.raw

SEQ ID NO: 600912 - DNA, 503 bp, Homo sapiens; identical to SEQ ID NO: 538884
  misc_feature: HIJSMM301AQY3I.27.78.H01.1.454.light.4.raw

SEQ ID NO: 600913 - DNA, 494 bp, Homo sapiens; identical to SEQ ID NO: 534992
  misc_feature: HIJSMM301BE5KW.9.1.A01.1.454.light.4.raw

SEQ ID NO: 600914 - DNA, 489 bp, Homo sapiens
  misc_feature: HIJSMM301EC99X.14.55.E11.1.454.light.4.raw
  modified_base (384)..(384): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagnttttgcaacttactactgtcaacagagttacagtacccccctcactttcggcggagggaccaaggcggagatcagacgaactgtggctgcaccatctgtcttcta

SEQ ID NO: 600915 - DNA, 477 bp, Homo sapiens; identical to SEQ ID NO: 552384
  misc_feature: HIJSMM301DVVM1.16.86.H09.1.454.light.4.raw

SEQ ID NO: 600916 - DNA, 516 bp, Homo sapiens
  misc_feature: HIJSMM301B5TAQ.14.7.A07.1.454.light.4.raw
cgtctagtaccacgaccggtgctcgatttagcacgtgtcgcagggggccctgaggaaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtcttttggggtccctgatcgcttctctggctccatccttgggaacaaggctgccctcaccatcacgggggcccagggcagatgatgaatctaattatcactgtgcgttgtatatgggttttggctatttcggtgttcggcggagggacccgaggtgaccgtcctacgtcacgcccaagg

SEQ ID NO: 600917 - DNA, 496 bp, Homo sapiens; identical to SEQ ID NO: 559952
  misc_feature: HIJSMM301CPTKK.16.78.H01.1.454.light.4.raw

SEQ ID NO: 600918 - DNA, 497 bp, Homo sapiens; identical to SEQ ID NO: 535664
  misc_feature: HIJSMM301DNYJ9.22.14.B03.1.454.light.4.raw

SEQ ID NO: 600919 - DNA, 503 bp, Homo sapiens; identical to SEQ ID NO: 539785
  misc_feature: HIJSMM301CULFO.48.67.G01.1.454.light.4.raw

SEQ ID NO: 600920 - DNA, 499 bp, Homo sapiens; identical to SEQ ID NO: 543922
  misc_feature: HIJSMM301CZKBO.18.11.A11.1.454.light.4.raw

SEQ ID NO: 600921 - DNA, 501 bp, Homo sapiens
  misc_feature: HIJSMM301AJ5CG.19.85.H08.1.454.light.4.raw
tactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctggtcagcccaaggctgcccctcggt

SEQ ID NO: 600922 - DNA, 478 bp, Homo sapiens; identical to SEQ ID NO: 543315
  misc_feature: HIJSMM301B1NVQ.26.72.G06.1.454.light.4.raw

SEQ ID NO: 600923 - DNA, 495 bp, Homo sapiens
  misc_feature: HIJSMM301AWC7R.22.27.C05.1.454.light.4.raw
acatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctcctcagacgttcgccaagggaccaaggtggaaatcaaacgaactgtggctgcacc

SEQ ID NO: 600924 - DNA, 507 bp, Homo sapiens; identical to SEQ ID NO: 535641
  misc_feature: HIJSMM301CIJ38.10.88.H11.1.454.light.4.raw

SEQ ID NO: 600925 - DNA, 484 bp, Homo sapiens; identical to SEQ ID NO: 535400
  misc_feature: HIJSMM301C1W9I.46.26.C04.1.454.light.4.raw

SEQ ID NO: 600926 - DNA, 508 bp, Homo sapiens; identical to SEQ ID NO: 576837
  misc_feature: HIJSMM301ESG38.19.78.H01.1.454.light.4.raw

SEQ ID NO: 600927 - DNA, 465 bp, Homo sapiens; identical to SEQ ID NO: 549885
  misc_feature: HIJSMM301DMJIF.11.70.G04.1.454.light.4.raw

SEQ ID NO: 600928 - DNA, 488 bp, Homo sapiens
  misc_feature: HIJSMM301DH7FU.14.53.E09.1.454.light.4.raw
cgtctagtaccacgaccggtgctcgatttagagagagtgtgttgggtttgggggggagcctagctgtgctgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattaattgtcaatcagcagtcagcacttaattcttatcgggtgttcggcggagggaccaagctgaccgtccta

SEQ ID NO: 600929 - DNA, 497 bp, Homo sapiens
  misc_feature: HIJSMM301CIZX4.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagttgaccgtcctaggtcagcccaaggctcgcccctcggtcactctcgttcccaccctcctcgagtgcgtct

SEQ ID NO: 600930 - DNA, 484 bp, Homo sapiens; identical to SEQ ID NO: 535400
  misc_feature: HIJSMM301E0WJI.46.26.C04.1.454.light.4.raw

SEQ ID NO: 600931 - DNA, 501 bp, Homo sapiens
  misc_feature: HIJSMM301E3GD1.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttctactttggtccgaggggaccgaaacctaggagtaatcagaacgaacgtcgtggcgtgca

SEQ ID NO: 600932 - DNA, 506 bp, Homo sapiens
  misc_feature: HIJSMM301BM8S3.49.41.D08.1.454.light.4.raw
agtcgagagacacgaccggtgctcgatttagtcacgcgagaaagggaaagggggcatgagcaaaactgacaagtcaaggcaggaagatgtcgccatcacaactcattgggtttctgctgctctgggttccagcctcctggggtgaagttgtgctgactcagtctccagactttcactctgtgaccccaaaggagaaagtcaccatcacctgccgggccagtcagaacattggtaataacttacactggtaccagcagaaaccagatcagtctccaaagctcctcatcaaatttgctacccagtccttctcaggggtcccctcgaggttcagtggcagtggatctgggacagacttcaccctcaccatcagtagcctggaacctgaagatgctgcagcgtattactgtcatcagactattactttaccggagactttcggccgaagggaccaaggtggaaatacaaacgaactgtggctgcaccatctgtcttcatcttcccgccat

SEQ ID NO: 600933 - DNA, 502 bp, Homo sapiens
  misc_feature: HIJSMM301C1VQS.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggctagtttattattgtcagcaatattatattcctcctcagtacgttcggccgaagggaccaaggtaggaaatcaaacgaactgtggctgcaccgt

SEQ ID NO: 600934 - DNA, 498 bp, Homo sapiens; identical to SEQ ID NO: 591555
  misc_feature: HIJSMM301AF0DL.21.15.B04.1.454.light.4.raw

SEQ ID NO: 600935 - DNA, 454 bp, Homo sapiens; identical to SEQ ID NO: 536347
  misc_feature: HIJSMM301BAAR4.19.86.H09.1.454.light.4.raw

SEQ ID NO: 600936 - DNA, 482 bp, Homo sapiens
  misc_feature: HIJSMM301ETR57.5.42.D09.1.454.light.4.raw
atcagacacgcacgaccggtgctcgatttagacacatacgcagggaaaggggggagtcagactcagtcaggacacagcatggacatgagggtccccgctcagctcctggggctcctgctgctctggctcccaggtgccgagggtgacatccagctgacccagacgccctccaccgtgtctgcattcgtaggagacagagtcacgatcacctgtcgggccagtcagaatattaacagatggttggcctggtatcaccagagaccaggagaagccccaaacctcctcatttttgatgcctccactttgaatggaggggtcccaccaacattcagcggcagtggatctgggacagagttcactctcacaatcagcagcctgcagcctgatgatcttggaacttattactgccaacaatataatagttattggacgttcggccagggacgaaggtcgaaatgagacgaactgtggctgcaccatct

SEQ ID NO: 600937 - DNA, 488 bp, Homo sapiens; identical to SEQ ID NO: 537260
  misc_feature: HIJSMM301EDIJ2.47.70.G04.1.454.light.4.raw

SEQ ID NO: 600938 - DNA, 485 bp, Homo sapiens; identical to SEQ ID NO: 536040
  misc_feature: HIJSMM301D588V.15.1.A01.1.454.light.4.raw

SEQ ID NO: 600939 - DNA, 506 bp, Homo sapiens
  misc_feature: HIJSMM301BE5DS.48.79.H02.1.454.light.4.raw
agtatacatacacgaccggtgctcgatttagtgtcacacgaagggaaagggggaggaactgctcagttaggacccagacggaaccatggaagccccagcgcagcttctcttcctcctgctactctggctcccagatgtcactggagaaaaaataatgacgcagtctccagcccccctgcctgtgtctccaggggaaagagccaccctctcctgcagggccagtcagagtattagcagtgacttaaccttctacaaccagagacctggccaggctcccaggctcctggccaggtttccaggctcctcatccatggtgcatccaccagggccactggtatctcagccaggttcagtgccagtgggcctgggacagagttcactctcaccatcaccagcctgcagtctgaagattttgcattttattactgtcagcactataataactggccacgtggacgttcggccaagggaccaaggtggaaatacaacgaactgtggctgcacta

SEQ ID NO: 600940 - DNA, 498 bp, Homo sapiens
  misc_feature: HIJSMM301E1JSN.12.87.H10.1.454.light.4.raw
atacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcattggggggaaaagtttgctttctggtatcagcagaagccaggccagtcccctgtcttggtcatctataaggatagcaggcggccctcagggattcctgagcgattctccggctccaactccggcaacacagccactctgaccatcagcgggacccacggctctcgatgaggctgactattactgccaggcgtgggacagctccacttcccgttatgtcttcggaggtgggaccatggtcaccgtcctacggtcagcccaagaccaaccccact

SEQ ID NO: 600941 - DNA, 520 bp, Homo sapiens
  misc_feature: HIJSMM301BXEYU.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtctaggtcagcccaaggctgccccctcggtccactctgttcccacct

SEQ ID NO: 600942 - DNA, 493 bp, Homo sapiens
  misc_feature: HIJSMM301BPSY4.15.74.G08.1.454.light.4.raw
tctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtgggagatagagtcaccatcacttgccgggccagtcagagtattagtacctggttggcctggtatcagcagaaaccagggaaagcccctaaactcctgatgtataaggcatctagcttagaaagtggggtgccatcaaggttcagcggcagtggatctgggacagaattcactctcaccatcagcaccctgcagcctgatgattttgcaacttattactgtcaacagtataatagtaattcctggacgttcggccaacgggaccgaaggtaggaaatacaaacgaactagtggctgcaccatctgtctt

SEQ ID NO: 600943 - DNA, 489 bp, Homo sapiens; identical to SEQ ID NO: 554439
  misc_feature: HIJSMM301D3DQB.14.55.E11.1.454.light.4.raw
  modified_base (427)..(427): a, c, t, g, unknown or other

SEQ ID NO: 600944 - DNA, 486 bp, Homo sapiens; identical to SEQ ID NO: 536261
  misc_feature: HIJSMM301CQWA7.26.55.E11.1.454.light.4.raw

SEQ ID NO: 600945 - DNA, 498 bp, Homo sapiens
  misc_feature: HIJSMM301EZXGP.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcagtgggtcaggcgctgatttcacactgagaatcagcagggtggaggctgaagatgtcggggtttattactgcatgcagggtacagtgtggccttcgctcgcattcggcggagggaccaaggtggagatcaaacgaactgtggctgc

SEQ ID NO: 600946 - DNA, 523 bp, Homo sapiens
  misc_feature: HIJSMM301D17ZL.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggccccaggggtttctgatcgcttctatggctccaagtctgcctacacggcctccctgaccatctccgggctccagcctgaggacgaggctgattattattgtagttcatatacaaccagtgactacttgggtgttcggcgggagggaccagggctgaccgtctaggtcagcccaaggctcgccccctcggtcactctgttcccaccct

SEQ ID NO: 600947 - DNA, 487 bp, Homo sapiens
  misc_feature: HIJSMM301AJDXC.52.83.H06.1.454.light.4.raw
cgcagtacgacacgaccggtgctcgatttagatcacgtgcgtcgcgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaattatttaaattggtatcagcagaaaccagggaaagcccctaaactcctgatctacgatgcatccaatttggaacaggggtcccatcaaggttcagtggaagtggttctgggacacattttactttcaccatcagcggccctgcagcctgaagatattgcaacatattactgtcaacagtatggtaatctcccactcactttcggcggagggaccaaggtcgagatcaaacgaactgtggctgcaccatctgtctt

SEQ ID NO: 600948 - DNA, 493 bp, Homo sapiens; identical to SEQ ID NO: 538503
  misc_feature: HIJSMM301CTHAE.9.1.A01.1.454.light.4.raw

SEQ ID NO: 600949 - DNA, 511 bp, Homo sapiens; identical to SEQ ID NO: 548435
  misc_feature: HIJSMM301B5DZJ.7.86.H09.1.454.light.4.raw

SEQ ID NO: 600950 - DNA, 468 bp, Homo sapiens
  misc_feature: HIJSMM301CGXUQ.48.70.G04.1.454.light.4.raw
agtatacatacacgaccggtgctcgatttagtgtagtgtgaagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttatcactatgtctcctggtaccaacagcaccctggcaaagcccccaaactcatgatttatgatatcactaagcggccctcaggggtccctgatcgcttctctggctcccagtctggcaacacggcctccctgaccatctctgggctccaggctgaggatgaggctgattattactgctgctcatatgcaggcagctacactttggtgttcggcggagggaccaag

SEQ ID NO: 600951 - DNA, 460 bp, Homo sapiens
  misc_feature: HIJSMM301AOUZM.49.8.A08.1.454.light.4.raw
agtcgagagacacgaccggtgctcgatttagcatactctacaggggagtcagtcctaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggacagcccctaagctcctgatcctcgatgcatccactttggaaacagggtcccatcaaggttcagtggaagtggctctgggacagattttactttcaccatcagcagactgcagcctgaagatattgcaacatattactgtcaacagtatgatagtctcccgctcactttcggcggagggaccaaggtggagatcaaacgaa

SEQ ID NO: 600952 - DNA, 509 bp, Homo sapiens
  misc_feature: HIJSMM301B85XL.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccacgtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatctgtcttcatcttcccgcc

SEQ ID NO: 600953 - DNA, 486 bp, Homo sapiens; identical to SEQ ID NO: 570036
  misc_feature: HIJSMM301ENSUF.46.35.D02.1.454.light.4.raw

SEQ ID NO: 600954 - DNA, 478 bp, Homo sapiens; identical to SEQ ID NO: 535129
  misc_feature: HIJSMM301AONGL.11.11.A11.1.454.light.4.raw

SEQ ID NO: 600955 - DNA, 506 bp, Homo sapiens
  misc_feature: HIJSMM301B3UV2.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggccgtccgggggccactttcggcccgtgggaccaaagtggatatcaaacgaactgtggctgcacatctgtctt

SEQ ID NO: 600956 - DNA, 502 bp, Homo sapiens
  misc_feature: HIJSMM301AJYZT.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgagctgacttattactgtgcatcacgggacgcaacatgggatgacaatctgagcggttgggtgttcggcggagggaccaaactgaccgtcctaggtcagcccaa

SEQ ID NO: 600957 - DNA, 518 bp, Homo sapiens; identical to SEQ ID NO: 581602
  misc_feature: HIJSMM301AMWRE.3.87.H10.1.454.light.4.raw

SEQ ID NO: 600958 - DNA, 483 bp, Homo sapiens
  misc_feature: HIJSMM301ARKE9.17.34.D01.1.454.light.4.raw
cgtagactagcacgaccggtgctcgatttagatcgtctgtgttgggtttgggtcatcacaatatctgcactggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggtcagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccaaggaccaaggtggaactcaaacgaactgtggctgcaccatctgtcttcatcttcccgccatctgactagtctacg

SEQ ID NO: 600959 - DNA, 497 bp, Homo sapiens
  misc_feature: HIJSMM301DHM66.52.29.C07.1.454.light.4.raw
cgcagtacgacacgaccggtgctcgatttagagtgctacgaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggacactgagaggccctcagggatccctgagcgattctctggctccacctcagggacactagtcacgttgaccatcagtggagtccaggcagaggacgaggctgactaccactgtcaatcaacagacagcagtggttcttatgtcttcgcaactgggaccaaggtcaccgtcctacggtcagcccaaggccaacccactgtcta

SEQ ID NO: 600960 - DNA, 496 bp, Homo sapiens; identical to SEQ ID NO: 571225
  misc_feature: HIJSMM301EBTKV.18.59.F04.1.454.light.4.raw

SEQ ID NO: 600961 - DNA, 479 bp, Homo sapiens
  misc_feature: HIJSMM301DFUSS.10.1.A01.1.454.light.4.raw
catagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatgggacaccggcctcagtgcgtgggtttcggcggagggaccaagctgaccgtcctaggtcac

SEQ ID NO: 600962 - DNA, 483 bp, Homo sapiens
  misc_feature: HIJSMM301DRTW6.48.86.H09.1.454.light.4.raw
agtatacatacacgaccggtgctcgatttagtgctatagacttgggtttgggggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcacttgccgggcaagtcaggacattaaaagtgatttagcctggtatcagcagaaaccagggagagcccctaagctcctcatctatgctgcttccattttacaaagtggagtctcatcaaggttcagcggcggtggatctggcacagatttcactctcaccatcagcagcctgcagcctgaagattttgcaacttattactgtctgcacgattacaattaccctcggacgtcgtccaggaccgaaggtggaagtcaaacgaactagtggcgtgcacca

SEQ ID NO: 600963 - DNA, 508 bp, Homo sapiens
  misc_feature: HIJSMM301BAPI1.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaaccaaggtcaccgtctaggtcagcccaaggcccaaccccactgtcta

SEQ ID NO: 600964 - DNA, 523 bp, Homo sapiens
  misc_feature: HIJSMM301DC4J4.17.31.C09.1.454.light.4.raw
  modified_base (515)..(515): a, c, t, g, unknown or other
cgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagaaacactggagctgtcaccaatggtcattatccctactggttccaacagaagcctggccaagcccccaggacactgatttatgatacaaacaacaaacactcctggacccctgcccggttctcaggctccctcgttggggcaaagctgccctgacccttcgggtgcgcagcctgaggatgaggctgagtattactgcttgctctcctatagtggtgttcggggtgttcggcggagggaccaagctgaccgtcctaggtcagcccaaggctgccccctcggtcactctgttcccgccctccncctagtct

SEQ ID NO: 600965 - DNA, 496 bp, Homo sapiens; identical to SEQ ID NO: 535109
  misc_feature: HIJSMM301D5RQQ.16.78.H01.1.454.light.4.raw

SEQ ID NO: 600966 - DNA, 516 bp, Homo sapiens
  misc_feature: HIJSMM301B5LDY.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggtcttttcggcggagggaccgaagctcgaccgtccgtcgggtcacgcccgaaggctcgcccccgtccggtccta

SEQ ID NO: 600967 - DNA, 495 bp, Homo sapiens; identical to SEQ ID NO: 535821
  misc_feature: HIJSMM301A4O23.3.31.C09.1.454.light.4.raw

SEQ ID NO: 600968 - DNA, 513 bp, Homo sapiens
  misc_feature: HIJSMM301CJ4VI.5.58.F03.1.454.light.4.raw
  modified_base (416)..(416): a, c, t, g, unknown or other
atcagacacgcacgaccggtgctcgatttagtctgatcgagaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttacngctgctcatatgcaggtgatcacacttttatgttcgggactgggaccaaggtcaccgtcctaggtcagcccaaggccaaccccactgtcactcttcg

SEQ ID NO: 600969 - DNA, 444 bp, Homo sapiens; identical to SEQ ID NO: 535594
  misc_feature: HIJSMM301CP8AZ.9.9.A09.1.454.light.4.raw

SEQ ID NO: 600970 - DNA, 476 bp, Homo sapiens; identical to SEQ ID NO: 537812
  misc_feature: HIJSMM301A1OTI.3.82.H05.1.454.light.4.raw

SEQ ID NO: 600971 - DNA, 505 bp, Homo sapiens; identical to SEQ ID NO: 536254
  misc_feature: HIJSMM301CTG4I.7.71.G05.1.454.light.4.raw

SEQ ID NO: 600972 - DNA, 505 bp, Homo sapiens
  misc_feature: HIJSMM301B101N.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggactggaccaaggtctccgtcctacgtcacgcccaaggccaactccactgtcactcc

SEQ ID NO: 600973 - DNA, 490 bp, Homo sapiens
  misc_feature: HIJSMM301BS0HA.13.87.H10.1.454.light.4.raw
tcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatctatgttgcatccactttgcaaagtgggtcccatcaaggttcagcggcagtggatctgggacagaattcactctcacaatcagcagcctgcagcctgaagattttgctaacttattactagtcaacagcttaatagttacccgctccagtttcggcggagggaccaaggtggagatcaaacggaactgtggctgcaccatctgt

SEQ ID NO: 600974 - DNA, 474 bp, Homo sapiens
  misc_feature: HIJSMM301BJ4X5.13.76.G10.1.454.light.4.raw
tcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaggtcacg

SEQ ID NO: 600975 - DNA, 521 bp, Homo sapiens; identical to SEQ ID NO: 539470
  misc_feature: HIJSMM301AFKZW.27.23.C01.1.454.light.4.raw

SEQ ID NO: 600976 - DNA, 488 bp, Homo sapiens
  misc_feature: HIJSMM301AOEP2.4.61.F06.1.454.light.4.raw
agcactgtagcacgaccggtgctcgatttagctacgctctaagggaagggggggtcagagctctggagaagagctgctcagttaggacccagagggaaccatggaaaccccagcgcagcttctcttcctcctgctactctggctcccagatgccgccggagaagttgtgctgacgcagtctccaggcaccctgtctttgtctccaggggagagcgccaccctctcctgcaggcccagtgaggcggtaaggagcgattacttagcctggtatcagcagaaacctggccaggctcccaggctcctcatccagggtgcatccaacagggccacgggcatcccagccaggttcagtggccgtgcgtctgggacagtcttcactctcaccatcagcggactggagcctgaagattttgctgtgtatttttgtcagcagtatggcacatcaccggtcaccttcggccaagggtcacggctggagattaaacgaa

SEQ ID NO: 600977 - DNA, 527 bp, Homo sapiens
  misc_feature: HIJSMM301DGAM8.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctcctgaccatctccgggctccagcctgaggacgaggctgattattattgtagttcatatacaaccacgtgacacttgggttgttcggtcgggaggaccgaggctgaccgtcctaggtcagcccaaggctgccccctcggtccactctgttccccaccct

SEQ ID NO: 600978 - DNA, 498 bp, Homo sapiens
  misc_feature: HIJSMM301A6X03.48.27.C05.1.454.light.4.raw
agtatacatacacgaccggtgctcgatttagacgcgatcgaagggtttgggggctacaacaggcaggcaggggcagcaagatggtgttgcagacccaggtcttcatttctctgttgctctggatctctggtgcctacggggacgtcgtgatgacccagtctccagactccctggcagtgtctctgggcgggagggccaccatcaactgcaagtccagccagagtattttatacagctcctacaataagagcgacttagcttggtaccagcagaaaccaggacagcctcctaagttgctcatttactgggcatctaaccggcaatccggggtccctgaccgattcagtggcagcgggtctgggacacatttcgctttcaccatcagcagcctgcaggctgaggatgtggcagtttattactgtcagcaatattatactactccgtggactttcggccaagggaccaaggtggaaatcagacgaactgtggctgcaccat

SEQ ID NO: 600979 - DNA, 505 bp, Homo sapiens
  misc_feature: HIJSMM301C60HX.17.41.D08.1.454.light.4.raw
cgtagactagcacgaccggtgctcgatttagtcacgcgagaaagggaaaggggagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagtgtttttaaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaatatggtggtacacccctcactttcggcggaggggccaaggtggagatcaagcgaactgtggctgcaccatctgtcttcatcttcccgc

SEQ ID NO: 600980 - DNA, 527 bp, Homo sapiens
  misc_feature: HIJSMM301EVQCM.48.83.H06.1.454.light.4.raw
agtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcggtgggacagcaacactcgcgtagttttccgggcggggggaccagggctcggacccggtcgggcggtcacgccccgaaggctccgcccccgtccgggtccacttcttcgttcccccta

SEQ ID NO: 600981 - DNA, 492 bp, Homo sapiens; identical to SEQ ID NO: 544236
  misc_feature: HIJSMM301EVJ3U.12.23.C01.1.454.light.4.raw

SEQ ID NO: 600982 - DNA, 454 bp, Homo sapiens; identical to SEQ ID NO: 534964
  misc_feature: HIJSMM301C31US.19.86.H09.1.454.light.4.raw

SEQ ID NO: 600983 - DNA, 497 bp, Homo sapiens; identical to SEQ ID NO: 545672
  misc_feature: HIJSMM301A7RGY.2.49.E05.1.454.light.4.raw

SEQ ID NO: 600984 - DNA, 505 bp, Homo sapiens; identical to SEQ ID NO: 578221
  misc_feature: HIJSMM301DEZ5D.19.78.H01.1.454.light.4.raw

SEQ ID NO: 600985 - DNA, 464 bp, Homo sapiens; identical to SEQ ID NO: 536640
  misc_feature: HIJSMM301CWQP5.26.78.H01.1.454.light.4.raw

SEQ ID NO: 600986 - DNA, 495 bp, Homo sapiens; identical to SEQ ID NO: 535486
  misc_feature: HIJSMM301B9F3R.26.72.G06.1.454.light.4.raw

SEQ ID NO: 600987 - DNA, 470 bp, Homo sapiens
  misc_feature: HIJSMM301DZL98.7.81.H04.1.454.light.4.raw
  modified_base (456)..(456): a, c, t, g, unknown or other
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactacccaatcacttcgcctggactgaagtgcatatgaanagaactgtgctgca

SEQ ID NO: 600988 - DNA, 497 bp, Homo sapiens; identical to SEQ ID NO: 545672
  misc_feature: HIJSMM301DO204.2.49.E05.1.454.light.4.raw

SEQ ID NO: 600989 - DNA, 499 bp, Homo sapiens; identical to SEQ ID NO: 571377
  misc_feature: HIJSMM301A7CT3.41.18.B07.1.454.light.4.raw

SEQ ID NO: 600990 - DNA, 466 bp, Homo sapiens; identical to SEQ ID NO: 536398
  misc_feature: HIJSMM301AQJGX.3.20.B09.1.454.light.4.raw

SEQ ID NO: 600991 - DNA, 488 bp, Homo sapiens; identical to SEQ ID NO: 535861
  misc_feature: HIJSMM301C08L0.14.55.E11.1.454.light.4.raw

SEQ ID NO: 600992 - DNA, 481 bp, Homo sapiens; identical to SEQ ID NO: 582228
  misc_feature: HIJSMM301CWE4H.11.76.G10.1.454.light.4.raw

SEQ ID NO: 600993 - DNA, 496 bp, Homo sapiens; identical to SEQ ID NO: 549958
  misc_feature: HIJSMM301BI8QB.10.25.C03.1.454.light.4.raw

SEQ ID NO: 600994 - DNA, 486 bp, Homo sapiens; identical to SEQ ID NO: 537310
  misc_feature: HIJSMM301CU5BY.15.28.C06.1.454.light.4.raw

SEQ ID NO: 600995 - DNA, 511 bp, Homo sapiens
  misc_feature: HIJSMM301CTBTB.48.62.F07.1.454.light.4.raw
agtatacatacacgaccggtgctcgatttagtagtcgcataaagggaaagggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacaatattattatactccgccgacgtcgtcggggccgaccggtacggaagtacaacgaactagtagcgtggcaccactactgtt

SEQ ID NO: 600996 - DNA, 496 bp, Homo sapiens
  misc_feature: HIJSMM301CWF3P.22.6.A06.1.454.light.4.raw
acatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgcttttttggtatcaacagaggccaggccacgcccctgtcttaatgatatataaagacagtgagaggccctcgagggatctctgagcgattctctgcctccagctcgagggacaacattcacattcgaccatcagtgaaagtccaggcagaagatgaggctgactattattgtcaatcaacagacagtagtgggaaatagtgtggtattcggacggagggaccaaactcgaaccgtcctaggtcacgcccaaggctcgccccccg

SEQ ID NO: 600997 - DNA, 491 bp, Homo sapiens; identical to SEQ ID NO: 535294
  misc_feature: HIJSMM301B2JJL.16.68.G02.1.454.light.4.raw

SEQ ID NO: 600998 - DNA, 519 bp, Homo sapiens
  misc_feature: HIJSMM301DIYQ4.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtccactctcgttcccaccctcctccgt

SEQ ID NO: 600999 - DNA, 503 bp, Homo sapiens; identical to SEQ ID NO: 559148
  misc_feature: HIJSMM301A19JV.7.31.C09.1.454.light.4.raw

SEQ ID NO: 601000 - DNA, 484 bp, Homo sapiens; identical to SEQ ID NO: 546338
  misc_feature: HIJSMM301CJ8YQ.52.69.G03.1.454.light.4.raw

SEQ ID NO: 601001 - DNA, 470 bp, Homo sapiens; identical to SEQ ID NO: 535302
  misc_feature: HIJSMM301CMNF8.13.76.G10.1.454.light.4.raw

SEQ ID NO: 601002 - DNA, 502 bp, Homo sapiens
  misc_feature: HIJSMM301BO4L2.12.48.E04.1.454.light.4.raw
atacgacgtacacgaccggtgctcgatttagagagcgtcacagagagaaggggagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggagcggcccccgactcctcatctttaataacaatcagcggccctcaggggtccctgaccgattctctggctccaagtctggcacctcagcctccctggccatcagtgggctccagtctgaggatgaggctgattattactgtgcatcatgggctgacaccctgactggtccgggagtgttcggcggaggaccaagctgaccgtcctaggtcagcccaaggcagccccctcggtcact

SEQ ID NO: 601003 - DNA, 492 bp, Homo sapiens
  misc_feature: HIJSMM301D5BP0.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccaggggaccaaggctggagatcaaacgaactgt

SEQ ID NO: 601004 - DNA, 486 bp, Homo sapiens; identical to SEQ ID NO: 535290
  misc_feature: HIJSMM301EDM2I.3.12.B01.1.454.light.4.raw

SEQ ID NO: 601005 - DNA, 441 bp, Homo sapiens; identical to SEQ ID NO: 550529
  misc_feature: HIJSMM301DQTIO.41.9.A09.1.454.light.4.raw

SEQ ID NO: 601006 - DNA, 484 bp, Homo sapiens; identical to SEQ ID NO: 535400
  misc_feature: HIJSMM301AQXHW.46.26.C04.1.454.light.4.raw

SEQ ID NO: 601007 - DNA, 487 bp, Homo sapiens
  misc_feature: HIJSMM301CYZMZ.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacattgggatagtagcctgagtagtgtggttttcggcggagggaccgaaactgaccgtcctaggtcagcccaaggctgccccctcggtcactctgttcccaccctcctctacgtgagct

SEQ ID NO: 601008 - DNA, 493 bp, Homo sapiens; identical to SEQ ID NO: 538136
  misc_feature: HIJSMM301EE94P.47.64.F09.1.454.light.4.raw

SEQ ID NO: 601009 - DNA, 485 bp, Homo sapiens
  misc_feature: HIJSMM301DI8LG.14.53.E09.1.454.light.4.raw
cgtctagtaccacgaccggtgctcgatttagagagagtgtgttgggtttgggggggagcctagctgtgctgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgcttttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaatcttatcggtgttcggcggagggaccaagctgaccgtccta

SEQ ID NO: 601010 - DNA, 489 bp, Homo sapiens; identical to SEQ ID NO: 535139
  misc_feature: HIJSMM301CGAWX.14.55.E11.1.454.light.4.raw

SEQ ID NO: 601011 - DNA, 487 bp, Homo sapiens; identical to SEQ ID NO: 594423
  misc_feature: HIJSMM301CLGJM.43.33.C11.1.454.light.4.raw

SEQ ID NO: 601012 - DNA, 515 bp, Homo sapiens
  misc_feature: HIJSMM301A34LO.16.1.A01.1.454.light.4.raw
tgtactactccacgaccggtgctcgatttagacgtctcatcaggggggggtcgtcaggaggcagcgctctcaggacatctccaccatggcctgggctctgctgctcctcaccctcctcactcagggcacagggtcctgggcccagtctgccctgactcagcatgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcacgcccaacggctcgcccccctcggtcacctcttcg

SEQ ID NO: 601013 - DNA, 495 bp, Homo sapiens; identical to SEQ ID NO: 545183
  misc_feature: HIJSMM301EQ7LZ.16.10.A10.1.454.light.4.raw

SEQ ID NO: 601014 - DNA, 500 bp, Homo sapiens
  misc_feature: HIJSMM301CWPYN.12.67.G01.1.454.light.4.raw
atacgacgtacacgaccggtgctcgatttagagtatacatattgggttgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcagagcccccaaactcatgatttttgatgtcactaatcggccctcaggggtttctgatcgcttctctggctccaagtctgactacacggcctccctgaccatctctgggctccaggctgaggacgaggctgattattactgtgcagcatgggatgacagcctgaatggtccggtattcggcggagggaccaagctgaccgtcctaggtcagcccaaggctgccccctc

SEQ ID NO: 601015 - DNA, 498 bp, Homo sapiens
  misc_feature: HIJSMM301A8X9O.49.66.F11.1.454.light.4.raw
agtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctaaagattttgcagtttattactgtcaacagcgtaccacaggattcactttcggccctgggaccagagtggatatcaaacgaactagtggctgcaccatctgtcttcatcttcccgccta

SEQ ID NO: 601016 - DNA, 504 bp, Homo sapiens
  misc_feature: HIJSMM301B3INH.9.53.E09.1.454.light.4.raw
tgatacgtctcacgaccggtgctcgatttagagagagtgtgttgggtttggggctttgcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaaggtgaccggtcctaggtcagcccaaggctcgcccctcggtcactctgttccctaccctcctcagacgtatca

SEQ ID NO: 601017 - DNA, 519 bp, Homo sapiens; identical to SEQ ID NO: 550353
  misc_feature: HIJSMM301EU7TL.5.27.C05.1.454.light.4.raw

SEQ ID NO: 601018 - DNA, 490 bp, Homo sapiens
  misc_feature: HIJSMM301ADR5M.4.57.F02.1.454.light.4.raw
agcactgtagcacgaccggtgctcgatttagctcgatatagttgggtttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaagattcagtggcagtggatctgggacagatttcactctcaccatcagtagtctacaacctgaagattttgcaacttactactgtcaacagagttacgatacccctccgctcactttcggcggagggaccaacggtggagatcaaacgaaactgtggctgcaccatc

SEQ ID NO: 601019 - DNA, 488 bp, Homo sapiens; identical to SEQ ID NO: 535990
  misc_feature: HIJSMM301D5ERE.11.28.C06.1.454.light.4.raw

SEQ ID NO: 601020 - DNA, 507 bp, Homo sapiens
  misc_feature: HIJSMM301C3E70.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgcccccccgactcaccttcgtccgaacggaacgacgactagaggattaaacgtaaacctagtggcgtcgcacccactctcttcttcctatt

SEQ ID NO: 601021 - DNA, 490 bp, Homo sapiens; identical to SEQ ID NO: 534991
  misc_feature: HIJSMM301CT0TH.48.75.G09.1.454.light.4.raw

SEQ ID NO: 601022 - DNA, 486 bp, Homo sapiens; identical to SEQ ID NO: 535290
  misc_feature: HIJSMM301BLLDC.3.12.B01.1.454.light.4.raw

SEQ ID NO: 601023 - DNA, 493 bp, Homo sapiens; identical to SEQ ID NO: 535745
  misc_feature: HIJSMM301C54WZ.47.78.H01.1.454.light.4.raw

SEQ ID NO: 601024 - DNA, 493 bp, Homo sapiens
  misc_feature: HIJSMM301DKMRW.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcaacaatattataataatccatttaatttcggcggagggaccaaggtggagatcaaacgaactagtggctgcaccatctgtcttcatcttcccgccta

SEQ ID NO: 601025 - DNA, 516 bp, Homo sapiens
  misc_feature: HIJSMM301EWMYN.10.86.H09.1.454.light.4.raw
catagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagtgtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggctttcggcggagggactaagttgaccgtcctacgtcagcccaaggctgccccctcggtcactctgttcccgccctcctccactactatg

SEQ ID NO: 601026 - DNA, 487 bp, Homo sapiens; identical to SEQ ID NO: 581197
  misc_feature: HIJSMM301EFH3J.41.2.A02.1.454.light.4.raw

SEQ ID NO: 601027 - DNA, 484 bp, Homo sapiens; identical to SEQ ID NO: 535400
  misc_feature: HIJSMM301BML9V.46.26.C04.1.454.light.4.raw

SEQ ID NO: 601028 - DNA, 499 bp, Homo sapiens
  misc_feature: HIJSMM301D61AR.43.83.H06.1.454.light.4.raw
tgtgagtagtcacgaccggtgctcgatttagatcacgtgcgtcgcggggggagaagagctgctcagttaggacccagagggaaccatggaaaccccagcgcagcttctcttcctcctgctactctggctcccagataccaccggagaaactgtgttgacgcagtctccaggcacgctgtctttgtctccaggggaaagagccaccctctcgtgtagggccagtcagagtgttatcaccgactccttagcctggtaccagcagaaacctggccaggctcccaggctcctcatatatggtgcatccagcaggatcactggcatcccagcgaggttcagtggccatgggtctgggacggagttcactctcaccatcagccgactggagcctgaagattttgcagtgtattactgtcaccagtatggtagctcacctaagacgttcggccaagggaccaaggtggaaatcaaacgaactagtggctgcaccatctgtcttcta

SEQ ID NO: 601029 - DNA, 482 bp, Homo sapiens
  misc_feature: HIJSMM301A5D8F.48.19.B08.1.454.light.4.raw
  modified_base (444)..(444): a, c, t, g, unknown or other
agtatacatacacgaccggtgctcgatttagtgagtcagtaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacacttgggtnttcgggcggagggaccaagctgaccgtcctaggtcacg

SEQ ID NO: 601030 - DNA, 477 bp, Homo sapiens
  misc_feature: HIJSMM301DIONB.26.72.G06.1.454.light.4.raw
agactatactcacgaccggtgctcgatttagctacgactgcaagggaaagggtgagatccctcactgtggctcactttcagcggagggaccacggtggagatcacacgtaagtgcactttcctaatgctttttcttataaggttttaagtttggagcgtttttgtgtttgagatgttagctcaggtcaattccaaagagtaccagattctttcaaaaagtcagatgagtaagggatagaaaattagttcaccttaaggaacagccaagcgctagccagttaagtgaggcatctcaattgcaaggttttctctgcatcggtcaggttagtgatattaacagcgaaaagagatttttgttaaggggaagtaatgaagttaacactgtggatcaccttcggccaagggacacgactggagattaaacgaactgtggctgcaccatctgtcttcatcttcccgccatctgaagtatagtct

SEQ ID NO: 601031 - DNA, 498 bp, Homo sapiens
  misc_feature: HIJSMM301BSBJM.41.18.B07.1.454.light.4.raw
tctatactatcacgaccggtgctcgatttagtcgctgcgtaaggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaagctgaccgtcctaggtcagcccaaggctgccccctcggtcactctcg

SEQ ID NO: 601032 - DNA, 504 bp, Homo sapiens; identical to SEQ ID NO: 585316
  misc_feature: HIJSMM301DBRZ2.17.27.C05.1.454.light.4.raw

SEQ ID NO: 601033 - DNA, 507 bp, Homo sapiens; identical to SEQ ID NO: 558849
  misc_feature: HIJSMM301CHPZX.40.41.D08.1.454.light.4.raw

SEQ ID NO: 601034 - DNA, 490 bp, Homo sapiens
  misc_feature: HIJSMM301EO5Y1.12.33.C11.1.454.light.4.raw
atacgacgtacacgaccggtgctcgatttagagtgagctcgttgggtttgggggcaggagtcagtctcagtcaggacacagcatggacatgagggtccccgctcagctcctggggctcctgctactctggctccgaggtgccagatgtgacatccagatgacccagtctccttcctccctgtctgcatctgtcggagacagcgtcaccatcacttgtcgggcaagtcagaacatttacaattatttaaattggtatcagcagaaaccagggaaagcccctaaactcctgatctatcatgaatccagtttgcgaagtggagtcccatcaaggttcagtggcactgggtctgagacagagttcactctcaccatcagcactctacagcctgaagattttgcaacttattattgtcaacaaagttatgagacccctgccactttcggtccctgggaccatagtggatatgaaacgaactagtggctgcaccat

SEQ ID NO: 601035 - DNA, 494 bp, Homo sapiens; identical to SEQ ID NO: 542264
  misc_feature: HIJSMM301DDKUP.13.6.A06.1.454.light.4.raw

SEQ ID NO: 601036 - DNA, 481 bp, Homo sapiens
  misc_feature: HIJSMM301CM3GP.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaaatcactttcggtccctcggacgtgtaagtgcatatagaagaagaactagtggcgt

SEQ ID NO: 601037 - DNA, 514 bp, Homo sapiens
  misc_feature: HIJSMM301BZAIP.15.34.D01.1.454.light.4.raw
tctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccttgatcgcttctctggctccatccttgggaacaaagctgccctcaccatcacgggggcccaggcagacgatgaatgtgattatcactgcgtcctttatgtggggcgtggcatttgggtgttcggcggagggaccaaactgaccgtcctaggtcagcccaaggctgccccctcggtcactctcg

SEQ ID NO: 601038 - DNA, 471 bp, Homo sapiens
  misc_feature: HIJSMM301BN4QI.48.49.E05.1.454.light.4.raw
agtatacatacacgaccggtgctcgatttagagcgactagcaacacacaaaggggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcgcttgccgggcaagtcaggacattaaaagtgatttaggctggtatcagcagaaaccagggaaagcccctaagctcctgatctatgctgcatccactttacaaagtggagtcccatcaaggttcagcggcagtggatctggcacagattttcactctcaccatcagcagcctgcagcctgaagattctgcaacttattactgtctacacgattacaattaccctcgtacgttcggccaagggaccaaggtggaaatcaaacgaa

SEQ ID NO: 601039 - DNA, 504 bp, Homo sapiens
  misc_feature: HIJSMM301BD0BQ.43.38.D05.1.454.light.4.raw
tgtgagtagtcacgaccggtgctcgatttagtatctgatagttgggtttggggtctgatttagtatctgatagttgggtttgggggagtcagacccagtcaggacacagcctggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagactattattacctggttggcctggtatcagcagaaaccagggaaagcccctaaactcctgatctttgaggcatctcgtttagaaagtggggtcccctcaaggttcagcggcagtgcatctgggacagatttcactctcaccatcagcagcctgcagcctgatgattttgcaacttattactgtcaacagtataatagttaccctggacgttcggccaaggaccagggtggaaatcaaacgaactagt

SEQ ID NO: 601040 - DNA, 502 bp, Homo sapiens
  misc_feature: HIJSMM301A1RGS.19.78.H01.1.454.light.4.raw
tactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaacggtcaccgtcctaggtcagcccaaggccaaccccacctgtcactctgttcccgcccctcctccacgagagta

SEQ ID NO: 601041 - DNA, 493 bp, Homo sapiens; identical to SEQ ID NO: 537281
  misc_feature: HIJSMM301ESVOV.9.1.A01.1.454.light.4.raw

SEQ ID NO: 601042 - DNA, 479 bp, Homo sapiens; identical to SEQ ID NO: 537141
  misc_feature: HIJSMM301D5OJJ.7.76.G10.1.454.light.4.raw

SEQ ID NO: 601043 - DNA, 444 bp, Homo sapiens
  misc_feature: HIJSMM301CCTTZ.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcagggatccctgaccgattctctggctccaagtctggcacctcagcctccctggccatcactgggcttcaggctgaggatgaggctgattattactgccactcctatgacagcagcctgagaagtgtggtattcggcggagggaccaagctgaccgtcctaggtcagcccaaggctgccccctcggtcactctgttcccgccctcctcagacgtatca

SEQ ID NO: 601044 - DNA, 515 bp, Homo sapiens; identical to SEQ ID NO: 564475
  misc_feature: HIJSMM301AQJAH.15.86.H09.1.454.light.4.raw

SEQ ID NO: 601045 - DNA, 493 bp, Homo sapiens; identical to SEQ ID NO: 535745
  misc_feature: HIJSMM301AMBK9.47.78.H01.1.454.light.4.raw

SEQ ID NO: 601046 - DNA, 491 bp, Homo sapiens; identical to SEQ ID NO: 555285
  misc_feature: HIJSMM301CVXLI.48.1.A01.1.454.light.4.raw

SEQ ID NO: 601047 - DNA, 490 bp, Homo sapiens; identical to SEQ ID NO: 570189
  misc_feature: HIJSMM301ATKRN.8.4.A04.1.454.light.4.raw

SEQ ID NO: 601048 - DNA, 494 bp, Homo sapiens; identical to SEQ ID NO: 534992
  misc_feature: HIJSMM301AVN4B.9.1.A01.1.454.light.4.raw

SEQ ID NO: 601049 - DNA, 508 bp, Homo sapiens
  misc_feature: HIJSMM301BSO9S.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagcctgaccgtcctaggtcagcccaaggctgccccccg

SEQ ID NO: 601050 - DNA, 494 bp, Homo sapiens
  misc_feature: HIJSMM301C3ZAY.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtccgctcactttcggcgggggaccgaaggtggagttcaaacgaactgtggctgcaccatctgtcttcatt

SEQ ID NO: 601051 - DNA, 502 bp, Homo sapiens; identical to SEQ ID NO: 536253
  misc_feature: HIJSMM301D5OEG.21.22.B11.1.454.light.4.raw

SEQ ID NO: 601052 - DNA, 503 bp, Homo sapiens
  misc_feature: HIJSMM301CBHAZ.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggccgattattattgtctgctcatatggaaggtacctactcttttctcttcggactgggaccacggtcaccgtcctacggtcagcccaaggccaaccccactcgt

SEQ ID NO: 601053 - DNA, 503 bp, Homo sapiens
  misc_feature: HIJSMM301DIIXH.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagcctcctcatcaagtatgcttcccagtccttctcaggggtcccctcgaggttcagtggcagtggatcgtgggacacatttcaccctcaccatcaatagcctggaagctgaagatgctgcaacttattactgtcatcagagtactacttactcaatgatcacctcggtccaaggacacgactaggagaattaaacg

SEQ ID NO: 601054 - DNA, 507 bp, Homo sapiens
  misc_feature: HIJSMM301B12PU.4.37.D04.1.454.light.4.raw
agcactgtagcacgaccggtgctcgatttagtagcatactgttgggtttgggggtgggctcaggaggcagagctctgggaatctcaccatggcctggacccctctcctgctccccctcctcactttctgcacagtctctgaggcctcctatgagctgacacagtcaccctcggtgtcagtgtccccaggacaaacggccaggatcacctgctctggagatgcattgccaaaaaaatatggttattggaaccagcagaagtcaggccaggcccctgtattggtcatctttgaggacagcaaccgaccctccgggatccctgagagattctctggctccacctcagggacaatggccaccttgactatcagtggggcccaggtggaggatgaagctgaatactactgttattcagcagacaacagtggtaagcagtggtattcggcggagggaccaagtcgaccgtcctgggtcagcccaaggctgccccctcggtcactctgttcccg

SEQ ID NO: 601055 - DNA, 454 bp, Homo sapiens; identical to SEQ ID NO: 534964
  misc_feature: HIJSMM301C3T0A.19.86.H09.1.454.light.4.raw

SEQ ID NO: 601056 - DNA, 511 bp, Homo sapiens
  misc_feature: HIJSMM301BQR08.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcgggcgttcggtccaagggaccgaaggtaggaaatacaaaacgaactagtaggctgcaccatctgtcttctatcttccccg

SEQ ID NO: 601057 - DNA, 500 bp, Homo sapiens
  misc_feature: HIJSMM301BNHKA.10.65.F10.1.454.light.4.raw
catagtagtgcacgaccggtgctcgatttagctacgctctaagggggcaggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactggggaaagcccctacactcctgatcaatgcagcgtccagtttacagagtggggtcccctcaaggttcagtggcagtggatctgggacagactttactctcaccatcagcgatctgcagcctgacgattttgcgacttactactgtcaacagagtttcccggaaccccgttactttcggcggagggaccaaggtggagatcaaacgaactgtggctgcaccatctgtcttcatcttccccg

SEQ ID NO: 601058 - DNA, 490 bp, Homo sapiens
  misc_feature: HIJSMM301BH6EK.48.75.G09.1.454.light.4.raw
agtatacatacacgaccggtgctcgatttagtatagacatcagggggatcaggacttctcagttcatcttctcaccatgaggctccctgctcagctcctggggctgctaatgctctggatccctggatccactgcgggtgttgtgttgacccaggctcccctgtctctgtccgtcacccctggacagccggccgccatgtcgtgcaattctagtcggagcctcttctatgaggacggcaggacctacttctattggtacatgcagaagccgggccggtctccacagctcctgatgtctgagatttccaggcgattccctggagtgccagagaggttcagtggcagcggagcagggacagagttcacactgaaatcagccgggtggaggctgaggatgttggcctttattactgcatgcaaggtatcttcctcccatacacttttcggcccggggaccaaggtggatctcaaaagaactagtggctgcacc

SEQ ID NO: 601059 - DNA, 483 bp, Homo sapiens
  misc_feature: HIJSMM301D2HOL.4.54.E10.1.454.light.4.raw
agcactgtagcacgaccggtgctcgatttagatcgtagcagaacacacaaagggggagtcagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagccctaagctcctgatctatgctgcatccagtttacaaagtgggtcccatcaagattcagtggcagtggatctgggacagatttcactctcaccatcagtagtctacaacctgaagattttgcaacttactactgtcaacagagttacgataccctccgctcactttcggcggagggaccaaggtggagatacaaacgaactgtggctgca

SEQ ID NO: 601060 - DNA, 494 bp, Homo sapiens; identical to SEQ ID NO: 576031
  misc_feature: HIJSMM301A77VX.12.23.C01.1.454.light.4.raw

SEQ ID NO: 601061 - DNA, 464 bp, Homo sapiens; identical to SEQ ID NO: 560455
  misc_feature: HIJSMM301DEQ0D.11.73.G07.1.454.light.4.raw

SEQ ID NO: 601062 - DNA, 504 bp, Homo sapiens; identical to SEQ ID NO: 549538
  misc_feature: HIJSMM301A5PWC.18.59.F04.1.454.light.4.raw

SEQ ID NO: 601063 - DNA, 447 bp, Homo sapiens; identical to SEQ ID NO: 535020
  misc_feature: HIJSMM301CHO2G.18.9.A09.1.454.light.4.raw

SEQ ID NO: 601064 - DNA, 502 bp, Homo sapiens; identical to SEQ ID NO: 552020
  misc_feature: HIJSMM301APK7C.49.82.H05.1.454.light.4.raw

SEQ ID NO: 601065 - DNA, 463 bp, Homo sapiens; identical to SEQ ID NO: 535062
  misc_feature: HIJSMM301BPERO.11.73.G07.1.454.light.4.raw

SEQ ID NO: 601066 - DNA, 486 bp, Homo sapiens
  misc_feature: HIJSMM301DICAS.41.5.A05.1.454.light.4.raw
tctatactatcacgaccggtgctcgatttagatagatagacagggggcaggagtcagacccagtcaggacacagcatggacatgagggtccccgctcagctcctggggctcctgctgctctggttcccaggttccagatgcgacatccagctgacccagtctccatcttctgtgtctgcatctgtaggagacagagtcaacatcacttgtcgggcgagtcagggtattaccagctggttagcctggtatcagcagaaaccagggaaagcccctaaactcctcgatctatgctgcatccagtttgcaaagtggggtcccagtcaagattcagaggcagtggatctgggacagatttcactctcactatcaacagcctgcagcctgaagattttgccacttactattgtcaacaggctgacagtttcccttcaccttcggcctaagggacacgactggacattaaacgaactcgtaggctagcaccta

SEQ ID NO: 601067 - DNA, 489 bp, Homo sapiens; identical to SEQ ID NO: 549527
  misc_feature: HIJSMM301DI4DD.15.49.E05.1.454.light.4.raw

SEQ ID NO: 601068 - DNA, 505 bp, Homo sapiens; identical to SEQ ID NO: 546412
  misc_feature: HIJSMM301BX122.22.21.B10.1.454.light.4.raw

SEQ ID NO: 601069 - DNA, 494 bp, Homo sapiens; identical to SEQ ID NO: 534994
  misc_feature: HIJSMM301BTRGD.27.78.H01.1.454.light.4.raw

SEQ ID NO: 601070 - DNA, 519 bp, Homo sapiens; identical to SEQ ID NO: 543159
  misc_feature: HIJSMM301D3KS5.27.23.C01.1.454.light.4.raw

SEQ ID NO: 601071 - DNA, 447 bp, Homo sapiens; identical to SEQ ID NO: 535020
  misc_feature: HIJSMM301BAT5Z.18.9.A09.1.454.light.4.raw

SEQ ID NO: 601072 - DNA, 514 bp, Homo sapiens; identical to SEQ ID NO: 538541
  misc_feature: HIJSMM301BYKAO.47.23.C01.1.454.light.4.raw

SEQ ID NO: 601073 - DNA, 491 bp, Homo sapiens; identical to SEQ ID NO: 535194
  misc_feature: HIJSMM301D2CF4.26.78.H01.1.454.light.4.raw

SEQ ID NO: 601074 - DNA, 491 bp, Homo sapiens; identical to SEQ ID NO: 584450
  misc_feature: HIJSMM301DD6OC.47.64.F09.1.454.light.4.raw

SEQ ID NO: 601075 - DNA, 485 bp, Homo sapiens; identical to SEQ ID NO: 539299
  misc_feature: HIJSMM301D2BF6.3.10.A10.1.454.light.4.raw

SEQ ID NO: 601076 - DNA, 495 bp, Homo sapiens; identical to SEQ ID NO: 535821
  misc_feature: HIJSMM301B4JL6.3.31.C09.1.454.light.4.raw

SEQ ID NO: 601077 - DNA, 491 bp, Homo sapiens; identical to SEQ ID NO: 587768
  misc_feature: HIJSMM301DGLP2.22.65.F10.1.454.light.4.raw

SEQ ID NO: 601078 - DNA, 501 bp, Homo sapiens; identical to SEQ ID NO: 579640
  misc_feature: HIJSMM301EY2KT.9.81.H04.1.454.light.4.raw

SEQ ID NO: 601079 - DNA, 489 bp, Homo sapiens
  misc_feature: HIJSMM301BDLJB.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctggggacagacttcactctcaccatcagcagcctagagcctgaagattttgcactttattactgtcagcagcgtagcaactggcctctcactttcggcggagggaccagggtggagatcagacgaactgtggctgcaccatct

SEQ ID NO: 601080 - DNA, 497 bp, Homo sapiens
  misc_feature: HIJSMM301CVPJH.19.71.G05.1.454.light.4.raw
tactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcccccgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtgatatcagacgaactgtggctgca

SEQ ID NO: 601081 - DNA, 494 bp, Homo sapiens; identical to SEQ ID NO: 535276
  misc_feature: HIJSMM301AL86I.16.6.A06.1.454.light.4.raw

SEQ ID NO: 601082 - DNA, 511 bp, Homo sapiens
  misc_feature: HIJSMM301CPQFJ.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctcgaccctgcccgattctcaggctccctccgttggggacaaagctcgcctgacactgtctggtgtgcagcctgaggacgaggctgactattactgcctactctactttggtggtgctgtgctattcggcggagggaccaagctgaccgtcttaagtcagccaaggctcgccccctcggtcactctgttcccta

SEQ ID NO: 601083 - DNA, 503 bp, Homo sapiens
  misc_feature: HIJSMM301CUC3P.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacacccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctcgccccctcggtcact

SEQ ID NO: 601084 - DNA, 494 bp, Homo sapiens; identical to SEQ ID NO: 562943
  misc_feature: HIJSMM301CE6BS.43.29.C07.1.454.light.4.raw

SEQ ID NO: 601085 - DNA, 506 bp, Homo sapiens
  misc_feature: HIJSMM301EW1EY.5.58.F03.1.454.light.4.raw
atcagacacgcacgaccggtgctcgatttagtctgatcgagaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtcagcccaaggccaaccccactgtcact

SEQ ID NO: 601086 - DNA, 506 bp, Homo sapiens; identical to SEQ ID NO: 534969
  misc_feature: HIJSMM301B7ECK.18.37.D04.1.454.light.4.raw

SEQ ID NO: 601087 - DNA, 520 bp, Homo sapiens
  misc_feature: HIJSMM301BIFM2.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggccaggctgaccgtcctaggtcagcccaaggctgccccctcggtcactctgttcccaccct

SEQ ID NO: 601088 - DNA, 496 bp, Homo sapiens; identical to SEQ ID NO: 537513
  misc_feature: HIJSMM301B071T.12.87.H10.1.454.light.4.raw

SEQ ID NO: 601089 - DNA, 501 bp, Homo sapiens
  misc_feature: HIJSMM301D2BTL.40.59.F04.1.454.light.4.raw
tctagcgactcacgaccggtgctcgatttagtacacacacttagggattggggggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagactttgcagtttattactgtcagcagcgtaccaactggccgctcactttcggcggagggaccaaggtggagatcaaacgaactgtggctgcaccatctgtcttcatcttcccg

SEQ ID NO: 601090 - DNA, 495 bp, Homo sapiens
  misc_feature: HIJSMM301A2L0E.16.78.H01.1.454.light.4.raw
tgtactactccacgaccggtgctcgatttagtgtgagtagtttgggtttgggggaggaactgctcagttaggacccagacggaccatggaagccccacgcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgactgtggctgcaccatctgt

SEQ ID NO: 601091 - DNA, 491 bp, Homo sapiens; identical to SEQ ID NO: 537135
  misc_feature: HIJSMM301AQF6R.21.46.E02.1.454.light.4.raw

SEQ ID NO: 601092 - DNA, 521 bp, Homo sapiens
  misc_feature: HIJSMM301CRPY7.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaattggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccgccct

SEQ ID NO: 601093 - DNA, 502 bp, Homo sapiens; identical to SEQ ID NO: 554531
  misc_feature: HIJSMM301C9UFM.21.81.H04.1.454.light.4.raw

SEQ ID NO: 601094 - DNA, 492 bp, Homo sapiens; identical to SEQ ID NO: 573597
  misc_feature: HIJSMM301D24SR.10.72.G06.1.454.light.4.raw

SEQ ID NO: 601095 - DNA, 472 bp, Homo sapiens; identical to SEQ ID NO: 536302
  misc_feature: HIJSMM301DQ0J6.18.76.G10.1.454.light.4.raw

SEQ ID NO: 601096 - DNA, 485 bp, Homo sapiens
  misc_feature: HIJSMM301D7MDR.21.4.A04.1.454.light.4.raw
tcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccagcagaagcctggccaggctcccaggttcctcatctatgctgggtcccacagggccactggcatcccagacaggttcagtggcagtgggtctgggacagacttcactctcatcattagcagactggagcctgaagatttcgcagtgtattactgtcagcagtatggaagttcacctctgtcgttcggccaaggaccaaggtagaatgaaacgaactgtgctgcaccat

SEQ ID NO: 601097 - DNA, 552 bp, Homo sapiens
  misc_feature: HIJSMM301AD8AE.49.87.H10.1.454.light.4.raw
agtcgagagacacgaccggtgctcgatttagcagtactgcgttgggtttgggggtgggtccaggaggcagaactctgggtgtctcaccatggcctggatccctctacttctccccctcctcactctctgcacaggctctgaggcctcctatgagttgatccagccaccctcggtgtcagtgtccccaggacagacggccaggattctttgctctggagatgcgttggcaaaacagttttgcttattggttccagcagaagccaggccaagcccctgtggtggtgatttataaaggctttcagaggccctcagggatccctgagcgattctctgggtccagctcagggacaacagccatgttgaccatcagtggagtccaggcagaagacgaggctgactattattgtcaatcagcagacaacaactgttgtttcttgtgtttttcggtcgggtaccggggccggaacggcgtcgtaccggtcccgttcgggttccggacggacccgaacggacgtcgcccccgtcccggtccgtactccttcgttcccctta

SEQ ID NO: 601098 - DNA, 500 bp, Homo sapiens
  misc_feature: HIJSMM301BFDSN.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcagggtattacacttatgtcttcggaattgggacgacggtcaccgtcctaggtcagccccaaggcccaaccc

SEQ ID NO: 601099 - DNA, 488 bp, Homo sapiens
  misc_feature: HIJSMM301AOTAI.41.10.A10.1.454.light.4.raw
tctatactatcacgaccggtgctcgatttagcgtcgatctcagggggcatgagcaagactgacaagtcaaggcaggaagatgttgccatcacaactcattgggtttctgctgctctgggttccagcctccaggggtgaaattgtgctgactcagtctccaggctttcagtctgtgactccaaaggagaaagtcaccatcacctgccgggccagtcagagcattgatagtgatttacactggtaccagcagaaaccaaatcagtctccaaagctcctcatcaagtattcttcccagtccatctcaggggtcccctcgaggttcagtggcagtggatctgggacagatttcaccctcaccatcagtagcctggaagctgaagatgctgcaacgtattactgtcatcagagtcgtagtttacctcaaacgttcggccaagggaccaaggtggaaatcaaacgaactgtggctgcaccatctgtcttcatcc

SEQ ID NO: 601100 - DNA, 506 bp, Homo sapiens
  misc_feature: HIJSMM301D9LRD.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccgaagggaccgaaggtggaaatacaaacgaactagtggctgcaccatctgtcttcatcttccccg

SEQ ID NO: 601101 - DNA, 487 bp, Homo sapiens
  misc_feature: HIJSMM301A4Q56.17.36.D03.1.454.light.4.raw
cgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagagtgttagcagctacttagcctggtaccaacagaaacctggccagtctcccaggctcctcatctatgatgcatccaacagggccactggcatcccagccaggttcagtggcagtgggtctgggacagacttcattctcaccatcagcagcctagagcctgaagattttgcagtttattactgtcagcagcgtagcaactggctcatcacccttcggccaagggacacgactggagatgaaacgaactgtggctgcacca

SEQ ID NO: 601102 - DNA, 472 bp, Homo sapiens; identical to SEQ ID NO: 550621
  misc_feature: HIJSMM301BVCY6.41.8.A08.1.454.light.4.raw

SEQ ID NO: 601103 - DNA, 478 bp, Homo sapiens
  misc_feature: HIJSMM301CS778.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgagatttgcagtttattactgtcagcactataataactggcctccgtacagttttggccaggggaccaagctggagatcaaacgaa

SEQ ID NO: 601104 - DNA, 490 bp, Homo sapiens
  misc_feature: HIJSMM301A6W1T.4.20.B09.1.454.light.4.raw
agcactgtagcacgaccggtgctcgatttagtgtagtgtgaagggggagctacaacaggcaggcaggggcagcaagatggtgttgcagacccaggtcttcatttctctgttgctctggatctctggtgcctacggggacatcgtgatgacccagtctccggactccctggctgtgtctctgggcgagagggccaccatcaactgcaagtccagccagagtgttttatacaactccaacaataagaactacttagcttggtaccagcagagaccaggacagcctcctaagctgctcatttactgggcatctacccgggaatccggggtccctgaccgattcagtggcagcgggtctgggacagatttcactctcgccatcagcagcctgcagcctgacgatgtggcagtttatactgccagcaatattatactgacccgtggacttcggccaagggaccaaggtggaaatcaaacgaactgtggctgcacc

SEQ ID NO: 601105 - DNA, 500 bp, Homo sapiens; identical to SEQ ID NO: 540219
  misc_feature: HIJSMM301B710R.43.34.D01.1.454.light.4.raw

SEQ ID NO: 601106 - DNA, 486 bp, Homo sapiens; identical to SEQ ID NO: 535043
  misc_feature: HIJSMM301D8Q9G.46.35.D02.1.454.light.4.raw

SEQ ID NO: 601107 - DNA, 447 bp, Homo sapiens
  misc_feature: HIJSMM301BIMGW.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactagtaccagcagcttccagggacacgcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccacctcctccatactcgta

SEQ ID NO: 601108 - DNA, 505 bp, Homo sapiens
  misc_feature: HIJSMM301DEG1Z.11.57.F02.1.454.light.4.raw
cgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagttacaccttagcctggtaccagcaaaaacctggccaggctccccggctcctcatctatggtgcatccaccagggccgctggtgtcccacccaggttcagtggcggtgggtctgggacagtgttcactctcaccatcagcagcctgcagtctgaagattttgcagtttattactgtcagcagtatagtaagtggccgctcactttcggcggagggaccaaggtggaggatcagacgaactgtggctgcaccatctgtcttcatcttccccg

SEQ ID NO: 601109 - DNA, 485 bp, Homo sapiens; identical to SEQ ID NO: 536307
  misc_feature: HIJSMM301A8YC5.46.35.D02.1.454.light.4.raw

SEQ ID NO: 601110 - DNA, 496 bp, Homo sapiens; identical to SEQ ID NO: 542070
  misc_feature: HIJSMM301EAY1W.22.14.B03.1.454.light.4.raw

SEQ ID NO: 601111 - DNA, 494 bp, Homo sapiens; identical to SEQ ID NO: 534992
  misc_feature: HIJSMM301BFKJD.9.1.A01.1.454.light.4.raw

SEQ ID NO: 601112 - DNA, 498 bp, Homo sapiens
  misc_feature: HIJSMM301ELQ06.2.34.D01.1.454.light.4.raw
acgctcgacacacgaccggtgctcgatttagatcgtctgtgttgggtttgggggctttgcctgggctctgctcctcctcaccctcctcactcagggcacagggtcctgggcccagtctgccctgactcagcccccctccgcgtccgggtctcctggacagtcagtcaccatctcctgcactggaatcagcagtgacctgagtccttataactatgtctcctggtaccaacaacacccaggcaaagcccccaaactcattatttatgaagtcactaagcggccctcaggggtccctgatcgcttctctggctccaagtctggcgagacggcctccctgaccgtctctgggctccaggctgaagatgaggctgattattactgcagctcatatgcaggcagcaacaatgtggcattcggcggagggaccaagctgaccgtcctgggtcagcccaaggctgccccctcggtcactctgttcccacctcctctgtcgagcgt

SEQ ID NO: 601113 - DNA, 502 bp, Homo sapiens
  misc_feature: HIJSMM301BZ9XC.8.24.C02.1.454.light.4.raw
ctcgcgtgtccacgaccggtgctcgatttagtacagatcgttagggaaaggggggtctcaggaggcagcgctctcgggacgtctccaccatggcctgggctctgttattcctcaccctcctcactcagggcacagggtccagggcccaatctgccctgactcagcctgcctccgtgtctgggtcgcctggacagtccgtcaccatctcctgcactggaagcagcagtgacattggttcttataatcatgtctcctggtaccaacagcaccccggcagagcccccaaactcatcatttatgatgtcactgatcgcccctcaggggtttcgaatcgcttctctggctccaagtctggcaacacggcctccctgaccatctctgggctccaggctgaggacgaggctcattattattgcagttcatatacgaccagcagcactctcgtggtcttcggcggagggaccaagttgaccgtcctaagtcagcccaaggctgccccctc

SEQ ID NO: 601114 - DNA, 476 bp, Homo sapiens
  misc_feature: HIJSMM301ATGK0.40.52.E08.1.454.light.4.raw
tctagcgactcacgaccggtgctcgatttagtcgagctctcagagagaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaactagcagtgacattggtgcttataactatgtctcctggtaccaacaacacccaggcgaggcccccaaactcatgatttatgatgtcaataatcggccctcaggggtttctaatcgcttctctggctccaagtctggcaacacggcctccctgaccatctctgggctccaagctgaggacgaggctgtttatttctgcagctcatatacaagcagcaacactctggtgttcgggcggagggaccaagctgaccgt

SEQ ID NO: 601115 - DNA, 488 bp, Homo sapiens
  misc_feature: HIJSMM301BTZM7.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggcggagggaccaaggtggagatacaaacgaac

SEQ ID NO: 601116 - DNA, 502 bp, Homo sapiens; identical to SEQ ID NO: 575571
  misc_feature: HIJSMM301DS7EN.12.67.G01.1.454.light.4.raw

SEQ ID NO: 601117 - DNA, 496 bp, Homo sapiens
  misc_feature: HIJSMM301DIID4.52.70.G04.1.454.light.4.raw
cgcagtacgacacgaccggtgctcgatttagtgtagtgtgaagggaaagggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggttttgatgtacactggtaccagcagcttccgggaacagcccccaaactcctcatctttggtaacagcaatcggccctccggggtccctgaccgattctctggctccaagtctggcacctcagcctccctggccatcactgggctccaggctgaggatgaggctgattattactgccagtcctatgacagcagcctgagtgtcttttgggtcttcggaactgggaccaagggtcaccgtccg

SEQ ID NO: 601118 - DNA, 520 bp, Homo sapiens; identical to SEQ ID NO: 567791
  misc_feature: HIJSMM301A363A.27.23.C01.1.454.light.4.raw

SEQ ID NO: 601119 - DNA, 494 bp, Homo sapiens
  misc_feature: HIJSMM301A82NQ.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcaggtgggtctgggacaggagttcattctcaccatcagcagcctgcagtctgaagtattttgctaatttattactgtcagcagtataataactggtggacgttcggccaagggaccaaggtaagaaatacaaacgaactgtggctgcaccatctgtt

SEQ ID NO: 601120 - DNA, 510 bp, Homo sapiens; identical to SEQ ID NO: 545115
  misc_feature: HIJSMM301BK6FI.19.59.F04.1.454.light.4.raw

SEQ ID NO: 601121 - DNA, 443 bp, Homo sapiens
  misc_feature: HIJSMM301EP7NE.5.9.A09.1.454.light.4.raw
  modified_base (426)..(426): a, c, t, g, unknown or other
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctgttcccnccctcctccgtgctgat

SEQ ID NO: 601122 - DNA, 511 bp, Homo sapiens
  misc_feature: HIJSMM301DTY2U.47.85.H08.1.454.light.4.raw
agctcacgtacacgaccggtgctcgatttagtatcactcagtcgcgggggctggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgttcgtttgggtgttcggcggagggaccaagttgaccgtcctaggtcagcccaaggctcgccccctcggtcacttc

SEQ ID NO: 601123 - DNA, 520 bp, Homo sapiens; identical to SEQ ID NO: 559743
  misc_feature: HIJSMM301DRP95.27.23.C01.1.454.light.4.raw

SEQ ID NO: 601124 - DNA, 515 bp, Homo sapiens
  misc_feature: HIJSMM301DDZS8.43.59.F04.1.454.light.4.raw
tgtgagtagtcacgaccggtgctcgatttagtacacacacttagggattgggggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcgggggcaaagctgccctgacactgtcaggtgtgcagcctgaggacgaggctgactattactgcctgctcatatatggtggcgcgtgggtgttcggcggagggaccaagctgaccgtcctgggtcagcccaaggctgccccctcggtcactctgttcccgccctcctca

SEQ ID NO: 601125 - DNA, 508 bp, Homo sapiens
  misc_feature: HIJSMM301C6AG7.52.76.G10.1.454.light.4.raw
cgcagtacgacacgaccggtgctcgatttagtcactcatacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataactctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatacacaaacagaaacacttgggtgttcggcggcgggaccaaactgaccgtcctacgtcagcccaaggctgccccctggtcactctgtcccg

SEQ ID NO: 601126 - DNA, 496 bp, Homo sapiens
  misc_feature: HIJSMM301CTUA1.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggtattttgcagtgtattactgtcagcagtatcataggtcaaacaccttcggccaagggacacgactggagaattaaaggaactgtggctgcaccatctgtcttcatcttccccg

SEQ ID NO: 601127 - DNA, 489 bp, Homo sapiens; identical to SEQ ID NO: 536013
  misc_feature: HIJSMM301EREBQ.26.23.C01.1.454.light.4.raw

SEQ ID NO: 601128 - DNA, 494 bp, Homo sapiens; identical to SEQ ID NO: 534994
  misc_feature: HIJSMM301B2T64.27.78.H01.1.454.light.4.raw

SEQ ID NO: 601129 - DNA, 505 bp, Homo sapiens; identical to SEQ ID NO: 536232
  misc_feature: HIJSMM301A43HN.47.65.F10.1.454.light.4.raw

SEQ ID NO: 601130 - DNA, 517 bp, Homo sapiens
  misc_feature: HIJSMM301AKFK4.12.55.E11.1.454.light.4.raw
atacgacgtacacgaccggtgctcgatttagcactcgcacgttgggtttgggggtggtagctcaggaagcagagcctggagcatctccactatggcctgggctccactacttctcaccctcctcgctcactgcacaggttcttgggccagctttttgctgactcagccccactctgtgtcggggtctccggggaagacggtaaccatctcctgcaccggcagcagtggcaacattgccacgaagtatgtgcagtggtaccagcagcgcccgggcagtgcccccaccactataatctatgaggatgaccgacgaccctctggggtccctgatcgtttctctggctccatcgacagctcctccaattctgccctccctcaccatctctggactcatgtctgaggacgaggctgactactactgtctagtcttatgataatacgtctttgttttttcggtcggcgggaccaagctgaccgtcctacggtcacgcccaacggctcgccccctccggtccta

SEQ ID NO: 601131 - DNA, 514 bp, Homo sapiens
  misc_feature: HIJSMM301CY06P.48.84.H07.1.454.light.4.raw
agtatacatacacgaccggtgctcgatttagcagacgtctgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacaactgcgacttttcggtcgggggaccggacggcgtgaccggccggcggtcgagccaacggcgtcgcccctcccggtcgtactctgttcccta

SEQ ID NO: 601132 - DNA, 456 bp, Homo sapiens
  misc_feature: HIJSMM301DTTMX.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttccccaccctcctcccacgagagta

SEQ ID NO: 601133 - DNA, 491 bp, Homo sapiens
  misc_feature: HIJSMM301AYF0M.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagttctccaggcaccctgtctttgtctccgaggggaaagagcccaccctctcctgcgagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagcgtggagatcaaacgaactgtggctgcaccat

SEQ ID NO: 601134 - DNA, 490 bp, Homo sapiens
  misc_feature: HIJSMM301CP0HH.21.65.F10.1.454.light.4.raw
tcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggctcctcatctatggtgcatccgccagggccactggaatcccagccaggttcagtggcactgggtctgggacagagttcactctcaccatcagcagcctgcagtctgaagattttgaagtttattctgtctgcagtacaatcagtggcctcggacgttcggccgaagggaccaaggtggaaatcaaacgaactgtggctgcaccatctgtcttcta

SEQ ID NO: 601135 - DNA, 447 bp, Homo sapiens; identical to SEQ ID NO: 535201
  misc_feature: HIJSMM301BTT4J.18.9.A09.1.454.light.4.raw

SEQ ID NO: 601136 - DNA, 497 bp, Homo sapiens
  misc_feature: HIJSMM301BFBAK.3.10.A10.1.454.light.4.raw
agacgcactccacgaccggtgctcgatttagcgtcgatctcaggggcagagctctggggaggaactgctcagttaggacccagacggaaccatggaagccccagcgcagcttctcttcctcctgctactctggctcccagatgccactggagaaatagtgatggcgcagtctccagccaccctgtctgtgtctccaggggaaagagccaccctctcctgcagggccagtcagtctgtttataacaacttagcctggtaccaacagagacctggccaggctcccaggctcctcatgtttggtgcttccaccagggccactggtatcccagccaggttcagtggcagtgggtctgggacagagttcactctcaccatcagcagcctgcagtctgaagattttgctaatttatttctgtcagcagtacaataattggcctttgacgttcggccaagggaccaaggtggaaactaaacgaactgtggctgcaccatctgtt

SEQ ID NO: 601137 - DNA, 493 bp, Homo sapiens
  misc_feature: HIJSMM301DY20A.51.81.H04.1.454.light.4.raw
cgatcgtatacacgaccggtgctcgatttagtagtgtagattcgcggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcta

SEQ ID NO: 601138 - DNA, 503 bp, Homo sapiens; identical to SEQ ID NO: 547049
  misc_feature: HIJSMM301D3AJV.18.59.F04.1.454.light.4.raw

SEQ ID NO: 601139 - DNA, 486 bp, Homo sapiens; identical to SEQ ID NO: 535385
  misc_feature: HIJSMM301EXRX3.19.71.G05.1.454.light.4.raw

SEQ ID NO: 601140 - DNA, 449 bp, Homo sapiens
  misc_feature: HIJSMM301AJ401.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtctactctgttccccaccctcctccatactcgta

SEQ ID NO: 601141 - DNA, 504 bp, Homo sapiens; identical to SEQ ID NO: 540538
  misc_feature: HIJSMM301BVW5W.7.71.G05.1.454.light.4.raw

SEQ ID NO: 601142 - DNA, 482 bp, Homo sapiens
  misc_feature: HIJSMM301BC6H1.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcggggtcccatctcggttcagtgcggtggatctaggacagaattcactctcaccatcaccaacctgcaccctgaagatgttggaagttattactgtcagacctatagtggtggcccgctcattttcggcggagggaccaaggtgcagatcaaacgaactgtggctgca

SEQ ID NO: 601143 - DNA, 444 bp, Homo sapiens; identical to SEQ ID NO: 537971
  misc_feature: HIJSMM301BHQ2C.2.76.G10.1.454.light.4.raw

SEQ ID NO: 601144 - DNA, 484 bp, Homo sapiens
  misc_feature: HIJSMM301BZRDP.52.4.A04.1.454.light.4.raw
cgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgttctggagataaaatggaggataaatatgtttcctggtatcgccagaagccaggccagtcgcctgtcctggtcatctatcacgataagaagcggccctcagggatccctgagcgattctctggctccaactctgggaacacagccactctgaccatcagcgggacccaggctatggatgaggctgactattactgtcagccgtgggacaggaagcactctgggtgttcgggcggagggaccaggctgaccgtcctaggtcagcccaaggctgccccccg

SEQ ID NO: 601145 - DNA, 516 bp, Homo sapiens; identical to SEQ ID NO: 595651
  misc_feature: HIJSMM301DSUGJ.22.36.D03.1.454.light.4.raw

SEQ ID NO: 601146 - DNA, 481 bp, Homo sapiens; identical to SEQ ID NO: 535993
  misc_feature: HIJSMM301EH4F0.21.25.C03.1.454.light.4.raw

SEQ ID NO: 601147 - DNA, 488 bp, Homo sapiens
  misc_feature: HIJSMM301CHMBX.49.42.D09.1.454.light.4.raw
agtcgagagacacgaccggtgctcgatttagacacatacgcagggaaagggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtcgttataactttgtctcctggtaccagcaacacccaggcaaggcccccaaactcttcatttatgatgtcactaatcggccctcagggtccctgatcgcttctctgcctccaagtctggcaacacggcctcctgaccatctctgggctccaggctgaggatgaggctcattattattgttgctcatatgcaggcaacttcgcttttgcttcggaactgggaccgaggtcaccgtcctgggtcagcccaagg

SEQ ID NO: 601148 - DNA, 508 bp, Homo sapiens; identical to SEQ ID NO: 537954
  misc_feature: HIJSMM301B6W2Z.4.57.F02.1.454.light.4.raw

SEQ ID NO: 601149 - DNA, 512 bp, Homo sapiens
  misc_feature: HIJSMM301AO175.43.59.F04.1.454.light.4.raw
tgtgagtagtcacgaccggtgctcgatttagtacacacacttagggagttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggctccctgaccatctctgggctccaggctgaggacgaggctgattattactgcaactcacttacaacgaccgacacttgcgtattcggcggcgggaccaagctgaccgtcctaggtcagcccaaggctgccccctggtcactctgtt

SEQ ID NO: 601150 - DNA, 511 bp, Homo sapiens
  misc_feature: HIJSMM301CBAVT.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgtcggtccagggaccgacacgtagaaagtagagacgaactagtggctgcgaccactctcgtcttctactcttcccgt

SEQ ID NO: 601151 - DNA, 494 bp, Homo sapiens; identical to SEQ ID NO: 535478
  misc_feature: HIJSMM301CP4YK.10.79.H02.1.454.light.4.raw

SEQ ID NO: 601152 - DNA, 494 bp, Homo sapiens; identical to SEQ ID NO: 534992
  misc_feature: HIJSMM301DZ7VR.9.1.A01.1.454.light.4.raw

SEQ ID NO: 601153 - DNA, 528 bp, Homo sapiens
  misc_feature: HIJSMM301CD76F.52.64.F09.1.454.light.4.raw
cgcagtacgacacgaccggtgctcgatttagcgcgtatacaaggggctgggcctaaggaagcagtactggtggtgcctcagccatggcctggaccgttctcctcctcggcctcctctctcactgcacagtctctgtgacctcctatgtgttgactcagccgccctcggtgtcagtggccccaggaaagacggccagtcttatttgtgggggagacaacattggaagtagaagtgtacactggtaccagaagaagtcaggccgggcccctgtcctggtcgtctctgaggatagcgaccggccctcagggatccctgagcgattctctggatccaactctggaggaaacacggccaccctgaccatcagcagagtcgaagccggggatgaggccgactattattgtcaggtgtgggattttagaagtgatcatccgggggtgttcggcggtgggaccaggttgaccggtcctaggtcagcccaaggctgccccctcggtcactctgttcccaccctcctctatacgatcg

SEQ ID NO: 601154 - DNA, 510 bp, Homo sapiens
  misc_feature: HIJSMM301A7R1E.9.21.B10.1.454.light.4.raw
tgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctcttttcaagatattcgggcggaggggacccagggctgaccggtcctgagtcagcccaaggctgccccccg

SEQ ID NO: 601155 - DNA, 486 bp, Homo sapiens
  misc_feature: HIJSMM301CDMPW.40.86.H09.1.454.light.4.raw
tctagcgactcacgaccggtgctcgatttagtgctatagacttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccggactgttctatacagctccaacaatgagaactacgttgcttggtaccagcagaaaccaggacagcctcctaagttgctcatttactgggcatctacccgggcatccggggtccctgaccgattcagtggcagcgggtctgggacagatttcactctcaccatcaacaacctgcaggctgaagatgtggcagtttattactgtcaacaatattatactactccgctcactttcggcggaggcaccaaggtggagatcagacgaa

SEQ ID NO: 601156 - DNA, 512 bp, Homo sapiens; identical to SEQ ID NO: 548157
  misc_feature: HIJSMM301EER39.17.33.C11.1.454.light.4.raw

SEQ ID NO: 601157 - DNA, 492 bp, Homo sapiens
  misc_feature: HIJSMM301CZ04Z.41.17.B06.1.454.light.4.raw
tctatactatcacgaccggtgctcgatttagtcgatagtgaagggcacgaccggtgctcgatttagtcgatagtgaagggggaggaactgctcagttaggacccagacggaaccatggaagccccagcgcagcttctcttcctcctgctactctggctcccagatatcacaggagagatagtgatgacgcagtctccagccaccctgtctctgtctccaggggaaagagcctccctctcctgcagggccagtcagaatattcgcggccacttagcctggtatcagcagaaacctggccaggctcccaggctcctcatctatgctgcatccaccagggccactggtatcccagccaggttcagtggcggtgggtctgggacagagtttactctcaccatcaacggcctgcagtctgaagattctgcagtttattactgtcagcagtatgttgactggcctccgctccactttcggcggagggaccgaaggtgg

SEQ ID NO: 601158 - DNA, 509 bp, Homo sapiens; identical to SEQ ID NO: 539359
  misc_feature: HIJSMM301D4TOH.47.85.H08.1.454.light.4.raw

SEQ ID NO: 601159 - DNA, 490 bp, Homo sapiens; identical to SEQ ID NO: 562259
  misc_feature: HIJSMM301A59R5.16.73.G07.1.454.light.4.raw

SEQ ID NO: 601160 - DNA, 506 bp, Homo sapiens
  misc_feature: HIJSMM301AWMQ9.14.3.A03.1.454.light.4.raw
cgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaagcccccaaactcattatttatgaggtcaataatcggccctcaggagtttctaatcgcttctctggctccaagtctggcaacacggcctccctgagcatctctgggctccaggctgaggacgaggctgattattactgcagctcatatactattagcagaactgtggttttcggcggagggaccaaggtgaccgtcctaggtcagcccaaggctcgccccctcggtcactctcg

SEQ ID NO: 601161 - DNA, 496 bp, Homo sapiens
  misc_feature: HIJSMM301C52Y5.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagccaaggctgccccctcggtcactctgttcccgccctcctccgagtgcgtct

SEQ ID NO: 601162 - DNA, 488 bp, Homo sapiens
  misc_feature: HIJSMM301C7A99.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcaacaatattataataatccatttaattcggcgagggaccaaggtgagatcaaacgaactgtgctgcaccatctgtcttcatcttcccgccta

SEQ ID NO: 601163 - DNA, 490 bp, Homo sapiens; identical to SEQ ID NO: 543909
  misc_feature: HIJSMM301DW1MF.14.55.E11.1.454.light.4.raw

SEQ ID NO: 601164 - DNA, 513 bp, Homo sapiens; identical to SEQ ID NO: 552481
  misc_feature: HIJSMM301BUCIM.43.19.B08.1.454.light.4.raw

SEQ ID NO: 601165 - DNA, 501 bp, Homo sapiens
  misc_feature: HIJSMM301DL98Z.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcaggtgggtctgggacagacttcactctcaccatcagcagacgtggacgcctagaagtattttgcagtctattactgtcagcagtatggtcaccgtacccaagtaacgttttcggccgacggggaccaagcgtaggagatacaaacgaactgtggctgcaccat

SEQ ID NO: 601166 - DNA, 511 bp, Homo sapiens
  misc_feature: HIJSMM301AW35B.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctggtcactctgttccccaccctcctcgctacgt

SEQ ID NO: 601167 - DNA, 527 bp, Homo sapiens; identical to SEQ ID NO: 582593
  misc_feature: HIJSMM301EK9D4.9.25.C03.1.454.light.4.raw

SEQ ID NO: 601168 - DNA, 495 bp, Homo sapiens
  misc_feature: HIJSMM301AEHHC.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggaggaccaagctgaccgtcctaggtcagcccaaggctgccccctcggtcactctgttcccaccctcctcgagtgcgtct

SEQ ID NO: 601169 - DNA, 501 bp, Homo sapiens
  misc_feature: HIJSMM301CGLLX.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccagggcaggcccctgtacttgtcatttatggtaagaataaccggccctcagggatcccagaccgattctctggctccgactcaggaaagacagcttccctgaccatcactggggctcaggcggaagatgaggctgactattactgtaactcccgggacagcagtgctgaccaggtggtattcggcggagggacccacctgaccgtcttaggtcagcccaaggctgccccctcggtca

SEQ ID NO: 601170 - DNA, 496 bp, Homo sapiens
  misc_feature: HIJSMM301EN721.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacacttccccggcaacgggacacgactggagattaaaggaactgtggctgcaccatctgtcttcatcttccccg

SEQ ID NO: 601171 - DNA, 497 bp, Homo sapiens
  misc_feature: HIJSMM301AUFSO.40.73.G07.1.454.light.4.raw
tctagcgactcacgaccggtgctcgatttagctctacgctcagggcacgaccggtgctcgatttagagtgagctcgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaagctgccctcaccattacgggggcccagccagaggatgagtcttattattactgcatgctccatgt

SEQ ID NO: 601172 - DNA, 508 bp, Homo sapiens
  misc_feature: HIJSMM301EGZ1O.15.66.F11.1.454.light.4.raw
tctacgtagccacgaccggtgctcgatttagtcacgcgagaaggggggggtcgtcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcaggggtccctgatcgcttctctggctccaagtctggcgactcggcctccctgaccgtctctgggctccagccctgaagatgaggctgatttattctgcggctcatatggagacaattacagcttttgtcttcggaagtgggaccaaggtcaccgtcctaagtcagcccaaggccaaccccatcgtcactctgttcccgccct

SEQ ID NO: 601173 - DNA, 495 bp, Homo sapiens; identical to SEQ ID NO: 547042
  misc_feature: HIJSMM301CYMIL.51.59.F04.1.454.light.4.raw

SEQ ID NO: 601174 - DNA, 509 bp, Homo sapiens
  misc_feature: HIJSMM301CGI7Y.48.70.G04.1.454.light.4.raw
agtatacatacacgaccggtgctcgatttagtgtagtgtgaagggaaagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcgggcgttcggtccgaagggaccgaacggtagggaaagtactaaacgaactagtggcgtgcgaccta

SEQ ID NO: 601175 - DNA, 513 bp, Homo sapiens
  misc_feature: HIJSMM301B8GWH.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctacttactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtccaggtcagcccaaggctgccccctggtcactctgttccccgccctcctcgagtagtaca

SEQ ID NO: 601176 - DNA, 474 bp, Homo sapiens; identical to SEQ ID NO: 561309
  misc_feature: HIJSMM301AIUQ7.5.12.B01.1.454.light.4.raw

SEQ ID NO: 601177 - DNA, 503 bp, Homo sapiens; identical to SEQ ID NO: 543363
  misc_feature: HIJSMM301A8ZM7.19.78.H01.1.454.light.4.raw

SEQ ID NO: 601178 - DNA, 475 bp, Homo sapiens
  misc_feature: HIJSMM301AIIGB.11.17.B06.1.454.light.4.raw
cgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaacagagttacagtaccccgtggacgttcggccaaggaccaacggtaggaaatacaaacgaactagtgg

SEQ ID NO: 601179 - DNA, 518 bp, Homo sapiens
  misc_feature: HIJSMM301CH6TA.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgctagtttattactgtcaacatcgtaccgagtcggccgtccgggggcctaccgtttcggcccgtcgggaccgaaggtggagatacaaacgaactgtggctgcaccatctgtcttcta

SEQ ID NO: 601180 - DNA, 500 bp, Homo sapiens
  misc_feature: HIJSMM301AN5I4.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggtcccgtcgggtaccgaactagtggagtatacaaacgaaactacgtggtcgtgcgaccactactgttc

SEQ ID NO: 601181 - DNA, 514 bp, Homo sapiens; identical to SEQ ID NO: 597680
  misc_feature: HIJSMM301EUEGK.22.36.D03.1.454.light.4.raw

SEQ ID NO: 601182 - DNA, 511 bp, Homo sapiens
  misc_feature: HIJSMM301BYSAZ.41.9.A09.1.454.light.4.raw
tctatactatcacgaccggtgctcgatttagcgagacgcgcaggggagcttcagctgtgggtagagaagacaggactcaggacaatctccagcatggccagcttccctctcctcctcaccctcctcactcactgtgcagggtcctgggcccagtctgtcctgactcagccaccctcagcgtctgggacccccgggcagacggtgaccatctcctgttctggaagcagttccaacatcggaagtaataatgtgaattggtaccggcaactcccaggaacggccccaaactcctcatacatagtaatgatcatccggcccctggggtccctgaccgatctctggctccaggtctgcgcctcagcctccctggtcattagtgggctccagtctgacgatgaggctgactattactgttcagcgtgggatgccagcccgaatcattggtggttcggcggagggaccaagctgaccgtcctaggtcagcccaaggctgccccctcggtcacttccg

SEQ ID NO: 601183 - DNA, 481 bp, Homo sapiens
  misc_feature: HIJSMM301DRWV0.13.4.A04.1.454.light.4.raw
tcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgcaacttattactgtctacaagatcacaattatcctgggacgttcggccaagggaccgaaggtaggaaatacaaacgaactagtggctgca

SEQ ID NO: 601184 - DNA, 517 bp, Homo sapiens
  misc_feature: HIJSMM301AY4MU.5.24.C02.1.454.light.4.raw
atcagacacgcacgaccggtgctcgatttagtacagatcgttagggaaagggggctggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgtaggtcactacgcgaccctccaggggtcccgtcgatcgcttctctggctccaagtctggcaacacggcctccctgaccgtctctgggctccaggctgaggatgaggctgattattactgcagctcatatgcaggcagcagcagtccccactgtgatcttcgggcggggggaccggaacgcgtgaccgtccgtacggtcgagcccaacggacg

SEQ ID NO: 601185 - DNA, 497 bp, Homo sapiens
  misc_feature: HIJSMM301DKW7J.8.10.A10.1.454.light.4.raw
ctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaagagccaccctctcctgcagggccagtcttagtgttagcaacttagcctggtaccaacagaaacctggccaggctcccaggctcctcatctctgatacatccaacagggccactggcatcccagccaggttcagtggcagtgggtctgggacagacttcactctcaccatcagcagcctagagcctgaagattttgcactttattactgtcagcagcgtagtaactggcctttcactttcggccctgggaccaaagtggatatcaaacgactgtggctgcaccatctgtcttcattcttcccgccat

SEQ ID NO: 601186 - DNA, 502 bp, Homo sapiens; identical to SEQ ID NO: 541971
  misc_feature: HIJSMM301ADEEI.4.39.D06.1.454.light.4.raw

SEQ ID NO: 601187 - DNA, 490 bp, Homo sapiens
  misc_feature: HIJSMM301EPRRH.13.39.D06.1.454.light.4.raw
tcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcgcggagggaccaaggtggagatcaaacgaa

SEQ ID NO: 601188 - DNA, 501 bp, Homo sapiens
  misc_feature: HIJSMM301DJ8LK.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctcctgacaatctctgggctccaggctgaggacgaggctgattactactgctgctcatatgcaggtcgtatctcttatgtcttcggaactgggaccaaggtcaccgtcctaggtcagcccaaggcccaacccactgtc

SEQ ID NO: 601189 - DNA, 515 bp, Homo sapiens
  misc_feature: HIJSMM301BE7G8.17.33.C11.1.454.light.4.raw
cgtagactagcacgaccggtgctcgatttagagtgagctcgttgggtttgggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctcccgtccttgggggcaaagctgccctgacactgtctggtgtgcagcctgaggacgaggctgactattactgcctactctactttggtggtgctgtgctattcggcggagggaccaagctgaccgtcttaagtcagcccaaggcctgccccctcggtcactctcgttcccta

SEQ ID NO: 601190 - DNA, 482 bp, Homo sapiens
  misc_feature: HIJSMM301ENQI0.13.73.G07.1.454.light.4.raw
  modified_base (366)..(366): a, c, t, g, unknown or other
tcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcanactgaaaatcagcagggtggaggctggaggatgttattgggctctattattgcatgcaagcaacacactggccgtacacttttggccgaggggaccaagctggagatcaatacgaa

SEQ ID NO: 601191 - DNA, 494 bp, Homo sapiens; identical to SEQ ID NO: 534992
  misc_feature: HIJSMM301B9MWQ.9.1.A01.1.454.light.4.raw

SEQ ID NO: 601192 - DNA, 489 bp, Homo sapiens
  misc_feature: HIJSMM301EOGF3.4.64.F09.1.454.light.4.raw
agcactgtagcacgaccggtgctcgatttagcgcgtatacagggggagtcagacccagtcaggacacagcgtggacatgagggtccccgctcagctcctggggctcctgctgctctggttcccaggttccagatgcgacatccagatgacccagtctccatcttccgtgtctgcatctgtgggcgacagagtcaccatcacttgtcgggcgagtcaggacattgggacccgattagcctggtatcagcagaaaccagggaaagcccctaacctcctcatctatgctgcgtccagtttgcacagtggggtcccattgaggttcagcggcagtggttctgagacagatttcagtctcaccatccgtgacctgcagcctgaagattttgcaacttacttttgtcaacagactaactcattccctcgcagttttggccgaggggaccaaggtggagatacaaacgaactgtggctgcaccatctgtcttcatt

SEQ ID NO: 601193 - DNA, 493 bp, Homo sapiens; identical to SEQ ID NO: 540127
  misc_feature: HIJSMM301AIZD8.10.17.B06.1.454.light.4.raw

SEQ ID NO: 601194 - DNA, 454 bp, Homo sapiens; identical to SEQ ID NO: 535005
  misc_feature: HIJSMM301BU4N4.19.86.H09.1.454.light.4.raw

SEQ ID NO: 601195 - DNA, 496 bp, Homo sapiens; identical to SEQ ID NO: 535541
  misc_feature: HIJSMM301AJARH.3.33.C11.1.454.light.4.raw

SEQ ID NO: 601196 - DNA, 447 bp, Homo sapiens; identical to SEQ ID NO: 535020
  misc_feature: HIJSMM301C385W.18.9.A09.1.454.light.4.raw

SEQ ID NO: 601197 - DNA, 487 bp, Homo sapiens; identical to SEQ ID NO: 535583
  misc_feature: HIJSMM301DMPIA.22.73.G07.1.454.light.4.raw

SEQ ID NO: 601198 - DNA, 515 bp, Homo sapiens
  misc_feature: HIJSMM301BBGA6.52.55.E11.1.454.light.4.raw
cgcagtacgacacgaccggtgctcgatttagcactcgcacgttgggtttggggctgggcctcaggaagcagcatcgggggtgccgcagccatggcctggaccgctctccttctgagcctccttgctcactttacagggtctgcggcctcccatgacctgactcagtcactctcagtgtcggtggccctgggacagacggccactattacctgtgggggatacaacattaggaactaaaaatgtgcagtggtaccagcagaagccaggccaggcccctgtgttggtcatctatagggatcggaagacgggcctctgggattcctgagcgattctctggctccaactcggagaacacggccaccctgaccatcagaagtgcccaagtcggtgatgaggcagactattactgccaggtgtgggacaggtggtgttgtgatagttcggcggaggaccaagctgaccgtcctaagtcagccaaggctcgccccctcggtcactctcgttcccgccctcct

SEQ ID NO: 601199 - DNA, 521 bp, Homo sapiens; identical to SEQ ID NO: 539470
  misc_feature: HIJSMM301DXE2M.27.23.C01.1.454.light.4.raw

SEQ ID NO: 601200 - DNA, 497 bp, Homo sapiens; identical to SEQ ID NO: 564748
  misc_feature: HIJSMM301ESG3E.52.37.D04.1.454.light.4.raw

SEQ ID NO: 601201 - DNA, 454 bp, Homo sapiens; identical to SEQ ID NO: 536347
  misc_feature: HIJSMM301A2BD5.19.86.H09.1.454.light.4.raw

SEQ ID NO: 601202 - DNA, 492 bp, Homo sapiens; identical to SEQ ID NO: 557028
  misc_feature: HIJSMM301CJKDV.51.6.A06.1.454.light.4.raw

SEQ ID NO: 601203 - DNA, 501 bp, Homo sapiens; identical to SEQ ID NO: 550139
  misc_feature: HIJSMM301AJFDO.15.56.F01.1.454.light.4.raw

SEQ ID NO: 601204 - DNA, 508 bp, Homo sapiens
  misc_feature: HIJSMM301BWSHA.9.21.B10.1.454.light.4.raw
tgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaacgcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagtatattcggcggagggaccaggctgaccgtcctgagtcagcccaaggctcgtccccccg

SEQ ID NO: 601205 - DNA, 491 bp, Homo sapiens
  misc_feature: HIJSMM301B9YG6.11.12.B01.1.454.light.4.raw
cgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaaataccaggcggccctctggggtccctgagcgattctccggctccggctctgggaacacagtcactctgaccatcagccgggacccaggctattgatgaggctgtctacttctgtcaggcgtgggacaacagcgtggtgttcggcggagggaccagtctgaccgtcttaggtcagcccaagg

SEQ ID NO: 601206 - DNA, 447 bp, Homo sapiens; identical to SEQ ID NO: 535201
  misc_feature: HIJSMM301CFAK5.18.9.A09.1.454.light.4.raw

SEQ ID NO: 601207 - DNA, 483 bp, Homo sapiens; identical to SEQ ID NO: 535413
  misc_feature: HIJSMM301BTHG4.26.78.H01.1.454.light.4.raw

SEQ ID NO: 601208 - DNA, 487 bp, Homo sapiens; identical to SEQ ID NO: 539157
  misc_feature: HIJSMM301DZ6J6.26.37.D04.1.454.light.4.raw

SEQ ID NO: 601209 - DNA, 505 bp, Homo sapiens
  misc_feature: HIJSMM301C25V5.15.86.H09.1.454.light.4.raw
tctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaaggacggttgggtgttcggcggagggaccaagctgaccgtcctaggtcagcccaaggctgccccctggtcactctgttccccgccctcctcg

SEQ ID NO: 601210 - DNA, 510 bp, Homo sapiens
  misc_feature: HIJSMM301B0GB5.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccactttcggccctgggaccgaaagtggatatacaaacgaactgtggctgcaccatctgtcttcta

SEQ ID NO: 601211 - DNA, 420 bp, Homo sapiens; identical to SEQ ID NO: 540533
  misc_feature: HIJSMM301AINH9.9.34.D01.1.454.light.4.raw

SEQ ID NO: 601212 - DNA, 502 bp, Homo sapiens; identical to SEQ ID NO: 539002
  misc_feature: HIJSMM301EN1AR.18.59.F04.1.454.light.4.raw

SEQ ID NO: 601213 - DNA, 478 bp, Homo sapiens
  misc_feature: HIJSMM301E0W65.48.2.A02.1.454.light.4.raw
agtatacatacacgaccggtgctcgatttagactcatctacagggggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggtccagggaccgaaagtggatgtcaaccgaactcgtggctgcaccta

SEQ ID NO: 601214 - DNA, 500 bp, Homo sapiens; identical to SEQ ID NO: 562651
  misc_feature: HIJSMM301D42QP.17.29.C07.1.454.light.4.raw

SEQ ID NO: 601215 - DNA, 502 bp, Homo sapiens; identical to SEQ ID NO: 543936
  misc_feature: HIJSMM301C7A83.15.1.A01.1.454.light.4.raw

SEQ ID NO: 601216 - DNA, 497 bp, Homo sapiens; identical to SEQ ID NO: 536376
  misc_feature: HIJSMM301AXNL0.22.9.A09.1.454.light.4.raw

SEQ ID NO: 601217 - DNA, 503 bp, Homo sapiens; identical to SEQ ID NO: 538973
  misc_feature: HIJSMM301D5F99.5.86.H09.1.454.light.4.raw

SEQ ID NO: 601218 - DNA, 511 bp, Homo sapiens
  misc_feature: HIJSMM301EWJW4.5.58.F03.1.454.light.4.raw
atcagacacgcacgaccggtgctcgatttagtctgatcgagaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtcagcccaaggccaaccccactgcactctcg

SEQ ID NO: 601219 - DNA, 491 bp, Homo sapiens
  misc_feature: HIJSMM301CFT3O.18.11.A11.1.454.light.4.raw
  modified_base (479)..(479): a, c, t, g, unknown or other
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtcttnatcttcccgcat

SEQ ID NO: 601220 - DNA, 495 bp, Homo sapiens
  misc_feature: HIJSMM301BPUHZ.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaacggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcaccatctgtctt

SEQ ID NO: 601221 - DNA, 474 bp, Homo sapiens
  misc_feature: HIJSMM301A2SJW.48.28.C06.1.454.light.4.raw
agtatacatacacgaccggtgctcgatttagagctcacgtattgggtttgggggggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggcctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagccc

SEQ ID NO: 601222 - DNA, 494 bp, Homo sapiens; identical to SEQ ID NO: 534994
  misc_feature: HIJSMM301D9R7Q.27.78.H01.1.454.light.4.raw

SEQ ID NO: 601223 - DNA, 484 bp, Homo sapiens
  misc_feature: HIJSMM301DMFEH.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcccgccctcctcgctagtaga

SEQ ID NO: 601224 - DNA, 458 bp, Homo sapiens
  misc_feature: HIJSMM301ATOF0.49.84.H07.1.454.light.4.raw
agtcgagagacacgaccggtgctcgatttagcagacgtctgtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggataaatatgctggctggtatcagcagaagccaggccagtcccctgtgttggtcatctatcaagataccaagcggccctcagggatccctgagcgattctctggctccaactctgggaacacagccactctgaccatcagcgggactcaggctatcgatgaggctgactattactgtcaggcgtgggacagccgcactggggtattcggcggagggaccaaggctgaccgt

SEQ ID NO: 601225 - DNA, 480 bp, Homo sapiens
  misc_feature: HIJSMM301A4SOB.51.61.F06.1.454.light.4.raw
cgatcgtatacacgaccggtgctcgatttagctacgctctaagggaaagggggctcagctcctggggctcctgctgctctggctcccaggtgccagatgtgacatccagttgacccagtctccatccttcctgtctgcatctgtaggagacagagtcaccatcacttgccgggccagtcagggcattagcatttctttagcctggtatcagcaaaaaccagggaaagcccctaagctcctgatctatgctgcatccactttgcaaactggagtcccatcaaggttcagcggcagtggatctgggacagaattcactctcacaatcagcagcctgcagcctgaagattttgcaacttattactgtcaacagcttaatacttatcctcggacgttcggtccaaggacaacggtggaaagtcaaacgaactgtaggctgcaccatctgtcttcactcttcccgcccactctgatcgtagcact

SEQ ID NO: 601226 - DNA, 447 bp, Homo sapiens; identical to SEQ ID NO: 535020
  misc_feature: HIJSMM301DOR1A.18.9.A09.1.454.light.4.raw

SEQ ID NO: 601227 - DNA, 494 bp, Homo sapiens
  misc_feature: HIJSMM301DCNJB.51.28.C06.1.454.light.4.raw
cgatcgtatacacgaccggtgctcgatttagagctcacgtattgggtttgggggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacagcgacactgccgtgttcggcgggggaccaagctgaccgtcctcggtcagcccaaggctcgccccctcggtcacttcc

SEQ ID NO: 601228 - DNA, 454 bp, Homo sapiens
  misc_feature: HIJSMM301BKI58.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgcccctccggtcactctgttcccaccctcctccacgacgagta

SEQ ID NO: 601229 - DNA, 453 bp, Homo sapiens
  misc_feature: HIJSMM301A6QAP.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgccccctcggtcactctgttcccaccctcctccacgaagta

SEQ ID NO: 601230 - DNA, 497 bp, Homo sapiens
  misc_feature: HIJSMM301EH6UI.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcacacgtgggacatgggcactgcgatcttcggcggagggaccaagctgaccgtcctgggtcagccaaggctcgccccctcggtcactccg

SEQ ID NO: 601231 - DNA, 493 bp, Homo sapiens; identical to SEQ ID NO: 576110
  misc_feature: HIJSMM301B1ZA8.47.64.F09.1.454.light.4.raw

SEQ ID NO: 601232 - DNA, 490 bp, Homo sapiens
  misc_feature: HIJSMM301BYZ0E.49.7.A07.1.454.light.4.raw
agtcgagagacacgaccggtgctcgatttagcacgtgtcgcagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcagcgtagcaactggcctctcactttcggcggagggaccaaggtggagatcaaacgaactgtggctgcaccatctgtt

SEQ ID NO: 601233 - DNA, 488 bp, Homo sapiens; identical to SEQ ID NO: 536851
  misc_feature: HIJSMM301EYC1S.41.2.A02.1.454.light.4.raw

SEQ ID NO: 601234 - DNA, 507 bp, Homo sapiens; identical to SEQ ID NO: 561702
  misc_feature: HIJSMM301ARBPQ.5.24.C02.1.454.light.4.raw

SEQ ID NO: 601235 - DNA, 507 bp, Homo sapiens; identical to SEQ ID NO: 536086
  misc_feature: HIJSMM301EFCTT.12.73.G07.1.454.light.4.raw

SEQ ID NO: 601236 - DNA, 503 bp, Homo sapiens
  misc_feature: HIJSMM301DG9G8.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtctattcggcggagggaccaagctgaccgtcctgggtcagcccaaggctgcccctcggtcactctgttcccaccctcctctacgtcgtat

SEQ ID NO: 601237 - DNA, 510 bp, Homo sapiens
  misc_feature: HIJSMM301BIOAE.19.72.G06.1.454.light.4.raw
tactctcgtgcacgaccggtgctcgatttagctacgactgcaagggaaaggggggggtcgcaagaggcagcgctctcgggacgtctccaccatggcctgggctctgctgctcctcactctcctcactcaggacacagggtcctgggcccagtctgccctgactcagcctgcctccgtgtctgagtctcttggacagtcgatcaccatctcctccactgggaccggtcgtgatgttgggacttatacccttgtctcctggtaccaacaataccccggcaaagcccccaaactcctgatttatgaggctcataagcggccctcaggggtttctgagcgcttctctggctccagggctgacaacacggcctacctgacgatctctgggctccaggctgaggacgaggctgactattattgctgcgcatacgcaggaagtagcacatgggtgtgcggcggagggaccaaggtgaccgtcctgggtcagcccaaggcctgccccctcggtcactc

SEQ ID NO: 601238 - DNA, 489 bp, Homo sapiens
  misc_feature: HIJSMM301AYFZ6.26.60.F05.1.454.light.4.raw
agactatactcacgaccggtgctcgatttagtacgtcatcagggaaagggggaggaactgctcagttaggacccagacggaaccatggaagccccagcgcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggagatcagacgaactgtggctgcaccatctgtt

SEQ ID NO: 601239 - DNA, 506 bp, Homo sapiens
  misc_feature: HIJSMM301CG6SY.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgttcgccagggaccgacagtacgaatagagacgaactacgtggctgcaccatctgtcttctactcttcccgt

SEQ ID NO: 601240 - DNA, 466 bp, Homo sapiens; identical to SEQ ID NO: 535366
  misc_feature: HIJSMM301DVGHR.13.4.A04.1.454.light.4.raw

SEQ ID NO: 601241 - DNA, 484 bp, Homo sapiens
  misc_feature: HIJSMM301EVBH0.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatgttggagtttattactgcatgcaagctctacaaactcctctcactttcggcggagggaccaaggtggagatcaaacgaac

SEQ ID NO: 601242 - DNA, 446 bp, Homo sapiens
  misc_feature: HIJSMM301EI9QN.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacaggtttgggtgtttgggtgttcggcggagggaccaagctgaccgtcctaagtcagcccaaggctcgccccctcggtcactctcgttcccaccctctccgtgtctgat

SEQ ID NO: 601243 - DNA, 514 bp, Homo sapiens
  misc_feature: HIJSMM301ET5T2.43.59.F04.1.454.light.4.raw
tgtgagtagtcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgaccatctctgggctccaggctgaggacgaggctgattattactgcaactcacttacaacgaccgacacttgcgtattcggcggcgggaccaagctgaccgtctaggtcagcccaaggctcgccccctcggtcactctcgtt

SEQ ID NO: 601244 - DNA, 509 bp, Homo sapiens
  misc_feature: HIJSMM301EBTQI.48.27.C05.1.454.light.4.raw
agtatacatacacgaccggtgctcgatttagacgcgatcgaagggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcaaaaacctggccaaactcccaggctcctcatctatggtgcatccaccagggccactggaatcccaaccaggttcagtggcagagggtctgggacggaattcactctcaccatcagcagtctgcagtctgaagattttgcagtttattattgtcagcagtataataattggcctccgggggtcactttcggccctggaccaaaataaatagtcaatcgaactgtggctgcaccatctgtcttcatcttccccg

SEQ ID NO: 601245 - DNA, 517 bp, Homo sapiens
  misc_feature: HIJSMM301ENSDW.49.55.E11.1.454.light.4.raw
agtcgagagacacgaccggtgctcgatttagcactcgcacgttgggtttggggagagaggcctggggagcccagctgtgctgtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccaagacaccagtgaaaatcacaagaggaatattcggcggagggaccaagctcgaaccgtcctaggtcagaccccg

SEQ ID NO: 601246 - DNA, 492 bp, Homo sapiens; identical to SEQ ID NO: 535126
  misc_feature: HIJSMM301CQMRK.18.11.A11.1.454.light.4.raw

SEQ ID NO: 601247 - DNA, 515 bp, Homo sapiens
  misc_feature: HIJSMM301A8LZV.47.55.E11.1.454.light.4.raw
agctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggagtcgcagcctgactgcttacgtcttcggtagctgggaccgaaggtcacccgtcctaggtcagcccaacggccaaccccgaa

SEQ ID NO: 601248 - DNA, 499 bp, Homo sapiens
  misc_feature: HIJSMM301C4MYI.12.87.H10.1.454.light.4.raw
atacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcattgggggaaaagtttgctttctggtatcagcagaagccaggccagtcccctgtcttggtcatctataaggatagcaggcggccctcagggattcctgagcgattctccggctccaactccggcaacacagcccactctgaccatcagcgggacccaggctctcgatgaggctgactattactgccaggcgtgggacagctccacttcccgttatgtcttcggaggtgggaccatggtcaccgtcctaggtcagcccaagacccaaccccactgt

SEQ ID NO: 601249 - DNA, 487 bp, Homo sapiens; identical to SEQ ID NO: 545757
  misc_feature: HIJSMM301A8J8U.49.3.A03.1.454.light.4.raw

SEQ ID NO: 601250 - DNA, 491 bp, Homo sapiens; identical to SEQ ID NO: 535176
  misc_feature: HIJSMM301CQGIH.13.39.D06.1.454.light.4.raw

SEQ ID NO: 601251 - DNA, 514 bp, Homo sapiens
  misc_feature: HIJSMM301A1CWS.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgtccaggaccgaacggtaggaagtacaagacgaactagtggcgtcgtcgaccaactctcgtcttctactcttcccgt

SEQ ID NO: 601252 - DNA, 509 bp, Homo sapiens
  misc_feature: HIJSMM301ARONO.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggacaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtctacgtcagcccaaggccaaccccactgtcactctgttcccta

SEQ ID NO: 601253 - DNA, 489 bp, Homo sapiens; identical to SEQ ID NO: 535139
  misc_feature: HIJSMM301CXB6M.14.55.E11.1.454.light.4.raw

SEQ ID NO: 601254 - DNA, 485 bp, Homo sapiens; identical to SEQ ID NO: 539576
  misc_feature: HIJSMM301CVSHA.4.57.F02.1.454.light.4.raw

SEQ ID NO: 601255 - DNA, 470 bp, Homo sapiens; identical to SEQ ID NO: 555914
  misc_feature: HIJSMM301C28KZ.4.79.H02.1.454.light.4.raw

SEQ ID NO: 601256 - DNA, 511 bp, Homo sapiens; identical to SEQ ID NO: 547172
  misc_feature: HIJSMM301CBOPK.11.57.F02.1.454.light.4.raw

SEQ ID NO: 601257 - DNA, 495 bp, Homo sapiens; identical to SEQ ID NO: 535596
  misc_feature: HIJSMM301DWBOA.10.79.H02.1.454.light.4.raw

SEQ ID NO: 601258 - DNA, 496 bp, Homo sapiens; identical to SEQ ID NO: 554024
  misc_feature: HIJSMM301CZCSB.40.57.F02.1.454.light.4.raw

SEQ ID NO: 601259 - DNA, 498 bp, Homo sapiens; identical to SEQ ID NO: 538056
  misc_feature: HIJSMM301B3KKE.15.25.C03.1.454.light.4.raw

SEQ ID NO: 601260 - DNA, 508 bp, Homo sapiens; identical to SEQ ID NO: 546226
  misc_feature: HIJSMM301AVPPA.53.71.G05.1.454.light.4.raw

SEQ ID NO: 601261 - DNA, 488 bp, Homo sapiens; identical to SEQ ID NO: 544026
  misc_feature: HIJSMM301CG85E.14.55.E11.1.454.light.4.raw

SEQ ID NO: 601262 - DNA, 517 bp, Homo sapiens
  misc_feature: HIJSMM301BU2Z8.41.33.C11.1.454.light.4.raw
tctatactatcacgaccggtgctcgatttagagtgagctcgttgggtttggggagtctgggcctaaggaagcagcactggtggtgcctcagccatggcctggaccgttctcctcctcggcctcctctctcactgcacagcctctgtgacctcctatgtgttgactcagccaccctcggcgtcagtggccctaggacagacggccaggattacctgtggggcaaataagataggaactacaaatgtgcactggtaccaacagaggccaggccaggcccctgtggtggtcgtccatgatgattacgaccggccctcaggaatccctgagcgattctctggctccaattctgggaacacggccaccctgaccatcaccgggggtcgaggccggggatgaggccacctactattgtcacgtctgggagactggtgatgatcctgtggcgctattcggcggagggacgaagctgaccgtcctgggtcagcccaaggctgccccctcggtcactctgttcccg

SEQ ID NO: 601263 - DNA, 508 bp, Homo sapiens
  misc_feature: HIJSMM301CN27X.8.34.D01.1.454.light.4.raw
ctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccactttcggccctcgggaccaaagtggatatcaaacgaactgtggctgcaccatctgtcttcta

SEQ ID NO: 601264 - DNA, 523 bp, Homo sapiens
  misc_feature: HIJSMM301C0M7O.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctcgccccctcggtccactctcgttcccacct

SEQ ID NO: 601265 - DNA, 469 bp, Homo sapiens
  misc_feature: HIJSMM301EFT5L.49.73.G07.1.454.light.4.raw
agtcgagagacacgaccggtgctcgatttagctctacgctcagggagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcgtgtatctgaattggtatcagcaaaaaccagggaaagcccctgagctcctgatcctcgatgcatccaatttggaaacaggggtcccatcgaggttctctggaagtggctctgggacacattttactttcaccatcagcagactgcagcctgaagatattgcaacatattactgtcaacagtatgataatctcccgctcactttcggcggagggaccaaggtggagatcaaacgaactgtggctgcacc

SEQ ID NO: 601266 - DNA, 501 bp, Homo sapiens
  misc_feature: HIJSMM301DNZGW.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtctgcgtcagcccaaggctcgccccctcggtcact

SEQ ID NO: 601267 - DNA, 495 bp, Homo sapiens; identical to SEQ ID NO: 537415
  misc_feature: HIJSMM301CTHSL.4.27.C05.1.454.light.4.raw

SEQ ID NO: 601268 - DNA, 472 bp, Homo sapiens; identical to SEQ ID NO: 538929
  misc_feature: HIJSMM301D0VU8.12.1.A01.1.454.light.4.raw

SEQ ID NO: 601269 - DNA, 494 bp, Homo sapiens
  misc_feature: HIJSMM301DTB26.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctacctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggcgggggaccaagctggagatcaaccgaactgtggctgcaccatctgt

SEQ ID NO: 601270 - DNA, 493 bp, Homo sapiens; identical to SEQ ID NO: 536769
  misc_feature: HIJSMM301C9AB6.19.83.H06.1.454.light.4.raw

SEQ ID NO: 601271 - DNA, 494 bp, Homo sapiens; identical to SEQ ID NO: 534994
  misc_feature: HIJSMM301AHKWL.27.78.H01.1.454.light.4.raw

SEQ ID NO: 601272 - DNA, 487 bp, Homo sapiens
  misc_feature: HIJSMM301CY349.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccagaacttttggcctagggaccaagcctggagatcaaacgaactagtggctgcaccat

SEQ ID NO: 601273 - DNA, 519 bp, Homo sapiens
  misc_feature: HIJSMM301A3Y5R.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgtcccaccctcctcgtcgtc

SEQ ID NO: 601274 - DNA, 474 bp, Homo sapiens; identical to SEQ ID NO: 549812
  misc_feature: HIJSMM301AUN2D.11.76.G10.1.454.light.4.raw

SEQ ID NO: 601275 - DNA, 498 bp, Homo sapiens
  misc_feature: HIJSMM301DVM5R.22.9.A09.1.454.light.4.raw
acatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtggggtctggaagagacttcactctcaccatcaacagcctagagcctgacgattctgcagtttattactgtcagcagcgtaccaagtggcctccgacttttggccagggggccaagctggagatcagacgaactgtggctgcaccatctgtcttcatcttccccg

SEQ ID NO: 601276 - DNA, 507 bp, Homo sapiens
  misc_feature: HIJSMM301EYEYQ.8.33.C11.1.454.light.4.raw
ctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggccccctcatctatggtgcatccaatagggccactggcatcccagccaggttcagtggcagtgggtatgggacagacttcactctcaccatcatcagcctggagcctgaagatgttgcagtttattactgtcaacatcgtaccgagtggcctccgggggccactttcggccctggaccaaattgagatacaaacgaactgtggctgcaccatctgtcttcta

SEQ ID NO: 601277 - DNA, 513 bp, Homo sapiens
  misc_feature: HIJSMM301DWSXG.13.33.C11.1.454.light.4.raw
tcacgtactacacgaccggtgctcgatttagagtgagctcgttgggtttggggctgggcctcaggaagcagcatcggggtgccgcagccatggcctggaccgctctcctgctgagcctccttgctcactttacagcttctgtggcctcctatgagttgactcagccactctcagtgtcagtggccccgggacagacggccacaattccctgtgagggaaacaaccttagaagtcagaatgtccactggtaccagcagaagtcaggccaggcccctgtggtggtcatctatagggataataaccggccctctgggatccctgaccgattctctggctccaactcggggaacacggcaccctgaccatcaacagagcccaagacggggatgaggctgactattattgtcaggtgtgggacagcaccacggtgatattcggcggcgggaccaagctgaccgtcctaggtcagcccaaggctgccccctcggtcactctgttcccacctcctctagt

SEQ ID NO: 601278 - DNA, 487 bp, Homo sapiens; identical to SEQ ID NO: 553099
  misc_feature: HIJSMM301ATV7N.13.5.A05.1.454.light.4.raw

SEQ ID NO: 601279 - DNA, 492 bp, Homo sapiens
  misc_feature: HIJSMM301DTI42.15.49.E05.1.454.light.4.raw
tctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgcagtttattactgtcagcagtataatgactggcctccgacgttcggccaagggaccaaggtggaaatacaaacgaactgtggctgcaccatctgtt

SEQ ID NO: 601280 - DNA, 508 bp, Homo sapiens; identical to SEQ ID NO: 550253
  misc_feature: HIJSMM301DF5KI.9.55.E11.1.454.light.4.raw

SEQ ID NO: 601281 - DNA, 483 bp, Homo sapiens
  misc_feature: HIJSMM301BN9K8.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcggccctggaccaagtggatatcaaacgaactgtggctgcacatctgtt

SEQ ID NO: 601282 - DNA, 447 bp, Homo sapiens; identical to SEQ ID NO: 535020
  misc_feature: HIJSMM301AMISB.18.9.A09.1.454.light.4.raw

SEQ ID NO: 601283 - DNA, 514 bp, Homo sapiens
  misc_feature: HIJSMM301CIKRA.5.59.F04.1.454.light.4.raw
atcagacacgcacgaccggtgctcgatttagtacacacacttagggattggggagagctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgttcggccgtaagggaccgaaggtaggaaagtacgaaacgaactacgtggcgtgcaccaatctgtcttctatcttccccg

SEQ ID NO: 601284 - DNA, 490 bp, Homo sapiens; identical to SEQ ID NO: 541244
  misc_feature: HIJSMM301BNC3J.41.44.D11.1.454.light.4.raw

SEQ ID NO: 601285 - DNA, 495 bp, Homo sapiens
  misc_feature: HIJSMM301EQ8V2.40.71.G05.1.454.light.4.raw
tctagcgactcacgaccggtgctcgatttagtgtcgtcgcaagagagagggggagctctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccgggacagaaggtcaccatctcctgctctggaagcagctccaacattgggaaaaattatgtatcctggtaccagcagctcccaggaacagcccccaaactcctcatttatgacaaataataagcgaccctcagggattcctgaccgattctctggctccaagtctggcacgtcagccaccctgggcatcaccggactccagactggcgacgaggccgtttattattgcggaacatgggatagcggcctgagtgatgagtggatggttcggcggcgggaccaaactgaccgtct

SEQ ID NO: 601286 - DNA, 505 bp, Homo sapiens; identical to SEQ ID NO: 536117
  misc_feature: HIJSMM301A2O6L.8.71.G05.1.454.light.4.raw

SEQ ID NO: 601287 - DNA, 506 bp, Homo sapiens; identical to SEQ ID NO: 536355
  misc_feature: HIJSMM301EX2CT.47.85.H08.1.454.light.4.raw

SEQ ID NO: 601288 - DNA, 495 bp, Homo sapiens; identical to SEQ ID NO: 550059
  misc_feature: HIJSMM301ECV7Y.49.22.B11.1.454.light.4.raw

SEQ ID NO: 601289 - DNA, 491 bp, Homo sapiens; identical to SEQ ID NO: 542796
  misc_feature: HIJSMM301ELE4H.19.57.F02.1.454.light.4.raw

SEQ ID NO: 601290 - DNA, 521 bp, Homo sapiens
  misc_feature: HIJSMM301C5KLL.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggccaacggaccgaacggtaggaaggtacgaaacgaactagtggcgtgcgaccactctgtcttcatcttcccgtccactctgat

SEQ ID NO: 601291 - DNA, 495 bp, Homo sapiens
  misc_feature: HIJSMM301EQHLE.12.38.D05.1.454.light.4.raw
atacgacgtacacgaccggtgctcgatttagtatctgatagttgggtttgggggaactgctcagttaggacccagacggaaccatggaagccccagcgcagcttctcttcctcctgctactctggctcccagattcctctggagaagttgtgatgacgcagtctccagccaccctgtctgcgtctccaggggaaagagtcaccctctcatgcagggccagtgagattgttaccaccaacttagcctggtaccaacagaaacctggccagcctcccaggctcctcatttatggtgcatccacaagggccgctggtgtcccagccaggttcagtggcagtggatctgcgacagagttcactctcaccgtcagcagcctgcagtctgaagattttgcagtttattactgtcagcagtatgagaagtggttcaagactttcggcggagggaccgaaggtggagatcaaacgaactgtggctgcaccatctgtcttctat

SEQ ID NO: 601292 - DNA, 487 bp, Homo sapiens; identical to SEQ ID NO: 597559
  misc_feature: HIJSMM301BCLFX.4.59.F04.1.454.light.4.raw

SEQ ID NO: 601293 - DNA, 489 bp, Homo sapiens; identical to SEQ ID NO: 535139
  misc_feature: HIJSMM301A9YA6.14.55.E11.1.454.light.4.raw

SEQ ID NO: 601294 - DNA, 514 bp, Homo sapiens; identical to SEQ ID NO: 541418
  misc_feature: HIJSMM301BF5K9.17.33.C11.1.454.light.4.raw

SEQ ID NO: 601295 - DNA, 491 bp, Homo sapiens
  misc_feature: HIJSMM301DLR9M.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagatttacactgaaaatcagcagagtggaggctgaggatgttggggtttattactgcatgcaagctctacaaactccttacacttttggccagggaccaagctggagatcaaacgaactgtgg

SEQ ID NO: 601296 - DNA, 506 bp, Homo sapiens
  misc_feature: HIJSMM301AFHY0.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaaggacggttgggtgttcggcggagggaccaagctgaccgtcctaggtcagcccaaggctcgccccctggtcactctgttcccgccctcctcg

SEQ ID NO: 601297 - DNA, 507 bp, Homo sapiens
  misc_feature: HIJSMM301E1LI0.48.57.F02.1.454.light.4.raw
agtatacatacacgaccggtgctcgatttagctcgatatagttgggtttgggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgtt

SEQ ID NO: 601298 - DNA, 500 bp, Homo sapiens
  misc_feature: HIJSMM301ESHC1.26.26.C04.1.454.light.4.raw
agactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaaggaccaaggtggaaagtcaaacgaactgtggctgcacc

SEQ ID NO: 601299 - DNA, 493 bp, Homo sapiens; identical to SEQ ID NO: 551874
  misc_feature: HIJSMM301DGVLW.18.11.A11.1.454.light.4.raw

SEQ ID NO: 601300 - DNA, 501 bp, Homo sapiens; identical to SEQ ID NO: 579640
  misc_feature: HIJSMM301BB2YI.9.81.H04.1.454.light.4.raw

SEQ ID NO: 601301 - DNA, 491 bp, Homo sapiens
  misc_feature: HIJSMM301D4A0K.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagattttcactctcaccatccgcggtctgcaacctgaagatttcgcaacttactactgtcaacagacttacagtgcccccccgatcaccttcggccaagggacacgactggagattaaacgaactgtggctgcaccatctgtcttcat

SEQ ID NO: 601302 - DNA, 495 bp, Homo sapiens
  misc_feature: HIJSMM301BR7CE.43.55.E11.1.454.light.4.raw
tgtgagtagtcacgaccggtgctcgatttagcactcgcacgttgggtttgggggctggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacactttatgtcttcggaattgggacgacggtcaccgtcctaggtcagcccaagg

SEQ ID NO: 601303 - DNA, 494 bp, Homo sapiens; identical to SEQ ID NO: 534992
  misc_feature: HIJSMM301BAVFO.9.1.A01.1.454.light.4.raw

SEQ ID NO: 601304 - DNA, 485 bp, Homo sapiens; identical to SEQ ID NO: 536799
  misc_feature: HIJSMM301D4H0D.19.71.G05.1.454.light.4.raw

SEQ ID NO: 601305 - DNA, 507 bp, Homo sapiens; identical to SEQ ID NO: 556014
  misc_feature: HIJSMM301DXECE.49.38.D05.1.454.light.4.raw

SEQ ID NO: 601306 - DNA, 499 bp, Homo sapiens
  misc_feature: HIJSMM301BW452.48.47.E03.1.454.light.4.raw
agtatacatacacgaccggtgctcgatttagactcgcgcacagagagaagggcacgaccggtgctcgatttagtgacatctcgcagttctttgggggagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacg

SEQ ID NO: 601307 - DNA, 490 bp, Homo sapiens; identical to SEQ ID NO: 576253
  misc_feature: HIJSMM301ATWY5.16.53.E09.1.454.light.4.raw

SEQ ID NO: 601308 - DNA, 504 bp, Homo sapiens; identical to SEQ ID NO: 558529
  misc_feature: HIJSMM301BVZ1T.41.35.D02.1.454.light.4.raw

SEQ ID NO: 601309 - DNA, 492 bp, Homo sapiens
  misc_feature: HIJSMM301CYDGZ.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgccaacctgaagtattttgctaacttactactgtcaacagagttacacgtacccccctcactttcggcggaggaccgaaggcggagatcagacgaactgtggctgcacatctgtcttcta

SEQ ID NO: 601310 - DNA, 518 bp, Homo sapiens
  misc_feature: HIJSMM301A99F3.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgccggcgtctggctgttcggcggagggaccaagctgaccgtcctaggtcagccaaggctgcccctcggtcactctgttcccaccctcctcacgcg

SEQ ID NO: 601311 - DNA, 508 bp, Homo sapiens
  misc_feature: HIJSMM301CAS0A.19.67.G01.1.454.light.4.raw
tactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagtttatactgtcagcaatatttttcttatcctccgtggacgttcgtccaacggacgacggtggaagtacagacgaactagtggcgtgcgaccact

SEQ ID NO: 601312 - DNA, 502 bp, Homo sapiens
  misc_feature: HIJSMM301BDK9X.43.34.D01.1.454.light.4.raw
tgtgagtagtcacgaccggtgctcgatttagatcgtctgtgttgggtttggggggggtcgacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaaccccta

SEQ ID NO: 601313 - DNA, 491 bp, Homo sapiens
  misc_feature: HIJSMM301DF1NY.47.36.D03.1.454.light.4.raw
  modified_base (480)..(480): a, c, t, g, unknown or other
agctcacgtacacgaccggtgctcgatttagctgcgtcacgatctctcgttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaagcccctaacctcctcatctctactgcatccactttgcaaagtggggtcccatcaaggttcagcggcagtggatctgggacagatttcactctcactatcagcagcctgcagcctgaagattttggaacttattattgtcaacagggtaacagtttcccgctcaccttcggcggagggaccaaggtggagatagaaaagaactgnggctgcaccat

SEQ ID NO: 601314 - DNA, 480 bp, Homo sapiens
  misc_feature: HIJSMM301AP7RE.4.32.C10.1.454.light.4.raw
agcactgtagcacgaccggtgctcgatttagtatagacatcaacacacaaagggggcaggagtcagactcagtcaggacacagcatggacatgagggtccccgctcagctcctggggctcctgctgctctggctcccaggtgccaaatgtgacatccagctgacccagtctccctccaccctgtctgcatctataggagacagagtcaccatcacttgccgggccagtcagagtattagtaactggttggcctggtatcagcagaaaccaggcaaagccccaaagctccttatctctgatgcctccactttgcacggtggcgtcccaccaacgttcagcggcagtggatctgggacagaattcactctcaccatcagcagcctgcagcctgatgatgttgctaacttattactgtcaacaatataacaattattggacgttcggccaaggaccgaaggtaggaaatacaaacgaactagt

SEQ ID NO: 601315 - DNA, 499 bp, Homo sapiens; identical to SEQ ID NO: 543604
  misc_feature: HIJSMM301DMYNA.12.86.H09.1.454.light.4.raw

SEQ ID NO: 601316 - DNA, 487 bp, Homo sapiens; identical to SEQ ID NO: 536206
  misc_feature: HIJSMM301AI0KT.47.38.D05.1.454.light.4.raw

SEQ ID NO: 601317 - DNA, 519 bp, Homo sapiens
  misc_feature: HIJSMM301D9903.9.2.A02.1.454.light.4.raw
tgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggtggctctaatcatgtctcctggtactataacagtccaggcaaagcccccaaactcataatttatgatgtctttagacggccctcagggatttcttctcggttgtctggctccaagtctgggaacacggcctccctgaccatctctggacttcagcctgaggacgagggtgattacttctgcagttcagattcagaacttcccctcgttgggtgttcggcgggagggaccatgctgaccgtcctgagtcagcccaaggctcgccccctcggtcactctcgttcccaccct

SEQ ID NO: 601318 - DNA, 336 bp, Homo sapiens
  misc_feature: HIJSMM301DC329.43.36.D03.1.454.light.4.raw
tgtgagtagtcacgaccggtgctcgatttagctgcgtcacgatctctcttgggatagaagttattcagcaggcacaagtcagggcagcctcctaagttgctcttttactggacttcgatccgcgcatctggggtccctgaccgattcatgggcagcggctctgggacagacttcgctctcaccatcaacagcctccaggctgaggatgcggcggtttattattgtcaacaatattttagtgctccgtacacttttggccaggggaccaagttggagatcaaacgaactgtggctgcaccatctgtcttcatcttcccgccatctgaactactcaca

SEQ ID NO: 601319 - DNA, 518 bp, Homo sapiens; identical to SEQ ID NO: 535407
  misc_feature: HIJSMM301AI442.22.30.C08.1.454.light.4.raw

SEQ ID NO: 601320 - DNA, 516 bp, Homo sapiens; identical to SEQ ID NO: 550591
  misc_feature: HIJSMM301AT7AR.16.83.H06.1.454.light.4.raw

SEQ ID NO: 601321 - DNA, 494 bp, Homo sapiens; identical to SEQ ID NO: 534992
  misc_feature: HIJSMM301BARRM.9.1.A01.1.454.light.4.raw

SEQ ID NO: 601322 - DNA, 493 bp, Homo sapiens
  misc_feature: HIJSMM301EI3T6.43.72.G06.1.454.light.4.raw
tgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagataaattgggggataaatatgcctcctggtatcagcagaagccaggcgagtcccctgtgttggtcatctatcaagatgacaaacggccctcagggatccctgagcgattctctggctccaactctgggaacacagccactctgaccatcagcgggacccaggctatggatgaggctgtacttttactgtcaggcgtgggacacaacactgtggtttcggcggaggaccaagctgaccgtcctaggtcagcccaaggctcgccccctcggtcta

SEQ ID NO: 601323 - DNA, 494 bp, Homo sapiens
  misc_feature: HIJSMM301C0311.13.56.F01.1.454.light.4.raw
tcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaagagccaccctctcctgcagggccagtcagacagttagcaacaacgtagcctggtaccagcagaaacgtggccaggctcccaggctcctcatctatggtgcatccaccagggccactggtatcccagaccggttcagtggcagtgggtctgggacagacttcactctcaccatcagcagtctgcagtctgaagattttgctagtttattactgtcagcagtataataactggcctccgtacatgtacacttttggccaggggaccaacctggagatcagacgaa

SEQ ID NO: 601324 - DNA, 494 bp, Homo sapiens; identical to SEQ ID NO: 535090
  misc_feature: HIJSMM301DH6VZ.27.78.H01.1.454.light.4.raw
  modified_base (403)..(403): a, c, t, g, unknown or other

SEQ ID NO: 601325 - DNA, 513 bp, Homo sapiens; identical to SEQ ID NO: 535719
  misc_feature: HIJSMM301E26DQ.17.33.C11.1.454.light.4.raw

SEQ ID NO: 601326 - DNA, 505 bp, Homo sapiens
  misc_feature: HIJSMM301CUUYY.17.41.D08.1.454.light.4.raw
cgtagactagcacgaccggtgctcgatttagtcacgcgagaaagggaaaggggagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagtgtttttaaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaatatggtggtacaccctcactttcggcggaggggccaaggtggagatcaagcgaactgtggctgcaccatctgtcttcatcttcccgcc

SEQ ID NO: 601327 - DNA, 490 bp, Homo sapiens
  misc_feature: HIJSMM301BJN10.13.36.D03.1.454.light.4.raw
tcacgtactacacgaccggtgctcgatttagctgcgtcacgatctcgtcttgggggggtcagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggctcctcatttatggtgcatccactagggccactggtgtcccagtcaggttcagcggcagtgggtctgggacagacttcactctcaccatcagcagcctgcagtctgaagattttgcagtctattactgtcagcagtatagttactggagaaccttcggccaagggacacgactggagtattaaacggaact

SEQ ID NO: 601328 - DNA, 477 bp, Homo sapiens
  misc_feature: HIJSMM301BVJIM.48.38.D05.1.454.light.4.raw
agtatacatacacgaccggtgctcgatttagtatctgatagttgggtttggggctggggagcctagctgtgctgtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaag

SEQ ID NO: 601329 - DNA, 498 bp, Homo sapiens; identical to SEQ ID NO: 574279
  misc_feature: HIJSMM301AG9BE.2.34.D01.1.454.light.4.raw

SEQ ID NO: 601330 - DNA, 496 bp, Homo sapiens
  misc_feature: HIJSMM301AEOYF.48.24.C02.1.454.light.4.raw
  modified_base (403)..(403): a, c, t, g, unknown or other
agtatacatacacgaccggtgctcgatttagtacagatcgttagggaaaggggatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattacngtcatcagacttttagttacgtcggaccttcggccaaggacacgactggagattaaacgaactgtggctgcaccatctgtcttcatcttcctg

SEQ ID NO: 601331 - DNA, 494 bp, Homo sapiens; identical to SEQ ID NO: 534992
  misc_feature: HIJSMM301DA557.9.1.A01.1.454.light.4.raw

SEQ ID NO: 601332 - DNA, 488 bp, Homo sapiens
  misc_feature: HIJSMM301CGO9Q.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccaaggaccgaaggtggaactacaaacgaa

SEQ ID NO: 601333 - DNA, 491 bp, Homo sapiens
  misc_feature: HIJSMM301BD5IF.53.34.D01.1.454.light.4.raw
cgcgtatacacacgaccggtgctcgatttagatcgtctgtgttgggtttggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaattggaggataaatatacttgctggtatcagcagaagccaggccagtcccctgtgttggtcatctatcaagataggaagcggccctcagggatccctgagcgattctctggctccaactctgggaacacagccactctgaccatcagcgggacccaggctatggatgaggctgactattattgtcaaaaggcgtgggacgagcaaccctgattgggtggttcggcggagggaccgaaactgaccgtcctaggtcagccaacggctcg

SEQ ID NO: 601334 - DNA, 518 bp, Homo sapiens
  misc_feature: HIJSMM301BAYT9.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctcgcccccctcggtccactctcgttcccaccctcct

SEQ ID NO: 601335 - DNA, 494 bp, Homo sapiens; identical to SEQ ID NO: 534994
  misc_feature: HIJSMM301AZ8H4.27.78.H01.1.454.light.4.raw

SEQ ID NO: 601336 - DNA, 486 bp, Homo sapiens; identical to SEQ ID NO: 535043
  misc_feature: HIJSMM301CIGI3.46.35.D02.1.454.light.4.raw

SEQ ID NO: 601337 - DNA, 513 bp, Homo sapiens
  misc_feature: HIJSMM301CRUYQ.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgcctcactttacaggttctgtggcctcctatgagctgactcagccactctcagtgtcagtggccccgggacagacggccaggattacctgtgggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagccggtgatgaggctgactattttgtcaggtgtgggacagcagcatttatgtcttcggacctgggaccaaggtcaccgtcctaggtcagcccaaggccaaccccactgtcactctgttcccgcctcctcgac

SEQ ID NO: 601338 - DNA, 499 bp, Homo sapiens
  misc_feature: HIJSMM301D9S26.22.57.F02.1.454.light.4.raw
acatacgcgtcacgaccggtgctcgatttagctcgatatagttgggtttgggggagtcagacccagtcaggacacagcatggacatgagggtccccgctcagctcctggggctcctgctgctctggctcccagggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaacagcctgcagcctgatgatttggcaacttactactgccaaccgtatagtacttattcggtcaccttcggccaagggacacgactggagattaaacgaactagtggctgcaccatctgtcttcattcc

SEQ ID NO: 601339 - DNA, 488 bp, Homo sapiens
  misc_feature: HIJSMM301DR8SR.49.12.B01.1.454.light.4.raw
agtcgagagacacgaccggtgctcgatttagtagtgtagattccgcgggggtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggcgggagggaccacggtggagatacaaacgaactgtggctgcaccatctgtctt

SEQ ID NO: 601340 - DNA, 497 bp, Homo sapiens
  misc_feature: HIJSMM301DGH1I.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattccctcctcagacgttcggccaagggaccaaggtggaaatcaaacgaactgtggctgcacc

SEQ ID NO: 601341 - DNA, 499 bp, Homo sapiens
  misc_feature: HIJSMM301EODJW.13.67.G01.1.454.light.4.raw
tcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggctagtttattactgtcagcaatattatagtactcctccgaggctcactttcggcggagggaccgaaggtggagatacaaacgaactgt

SEQ ID NO: 601342 - DNA, 513 bp, Homo sapiens
  misc_feature: HIJSMM301B3JIE.43.19.B08.1.454.light.4.raw
tgtgagtagtcacgaccggtgctcgatttagtgagtcagtaaggggggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggacaagagcactgtgattttcggcggaggggccaagttgaccgttttaggtcagcccaaggctcgccccctcggtcactctgttcccgccctcctcactactcaca

SEQ ID NO: 601343 - DNA, 467 bp, Homo sapiens; identical to SEQ ID NO: 535997
  misc_feature: HIJSMM301C4SB2.5.36.D03.1.454.light.4.raw

SEQ ID NO: 601344 - DNA, 489 bp, Homo sapiens
  misc_feature: HIJSMM301BVKSG.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagatttacgctagaaaatcagtagggtggaggctgaggatggttggggtttattactgcatgcaagttctacaaacttcctactacttttggccaggggaccaagctggagatcaaacgaa

SEQ ID NO: 601345 - DNA, 497 bp, Homo sapiens; identical to SEQ ID NO: 544443
  misc_feature: HIJSMM301BD1S4.51.39.D06.1.454.light.4.raw

SEQ ID NO: 601346 - DNA, 483 bp, Homo sapiens
  misc_feature: HIJSMM301BXAKK.51.41.D08.1.454.light.4.raw
cgatcgtatacacgaccggtgctcgatttagtcacgcgagaaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaaactcctgatctatgctgcatccagtttgcaaagtgaggtcccatccaggttcagtggcagtggatctgggacagatttcactctcaccatcagtagtctgcaacctgaagattttgcaacttactactgtcaacagagttacggtacctgctcactttcggcggagggaccgaaggtggagatcaaacgaactgtggctgcacca

SEQ ID NO: 601347 - DNA, 496 bp, Homo sapiens
  misc_feature: HIJSMM301EAE14.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggactttcggccctgggaccgaaagtaggagatcaaacgaactgtggctgcaccatctgtctt

SEQ ID NO: 601348 - DNA, 511 bp, Homo sapiens; identical to SEQ ID NO: 541549
  misc_feature: HIJSMM301C3RGT.40.33.C11.1.454.light.4.raw

SEQ ID NO: 601349 - DNA, 492 bp, Homo sapiens
  misc_feature: HIJSMM301CPTXR.9.12.B01.1.454.light.4.raw
  modified_base (429)..(429): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttcncgggcgttcggccaagggaccaaggtggaaatcaaacgaactagtggctgcacatctgtcttc

SEQ ID NO: 601350 - DNA, 485 bp, Homo sapiens
  misc_feature: HIJSMM301B39QW.15.1.A01.1.454.light.4.raw
  modified_base (484)..(484): a, c, t, g, unknown or other
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcccaccctcctcgctacgtana

SEQ ID NO: 601351 - DNA, 503 bp, Homo sapiens
  misc_feature: HIJSMM301AFJCX.17.26.C04.1.454.light.4.raw
cgtagactagcacgaccggtgctcgatttagtctagcgactttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgactaacttactactgtacaacagtaagttacaacctaccccgtcggctctacttcgggcggacgggacgaaggaggagataacaaacgaacgtggtggctgacacctatcttcg

SEQ ID NO: 601352 - DNA, 507 bp, Homo sapiens; identical to SEQ ID NO: 535641
  misc_feature: HIJSMM301AKOMQ.10.88.H11.1.454.light.4.raw

SEQ ID NO: 601353 - DNA, 500 bp, Homo sapiens
  misc_feature: HIJSMM301ARX4M.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccgggctcccaggctcctcatctatggtgcatccaccagggccactggtatcccagccaggttcagtggcagtgggtctgggacagagttcactctcaccatcagcagcctgcagtctgaagattttgcggttttattactgtcagcagtataataactggcctccacggtacacttttggccaggggaccaagctggagatcaaacgaactgtggctgcaccatctgtctt

SEQ ID NO: 601354 - DNA, 487 bp, Homo sapiens
  misc_feature: HIJSMM301EH3R2.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgctagtctattactgtcagcagtatggtcacgtcccaagaacttttggccagggaccaagctggagatacaaacgaactgtggctgcaccat

SEQ ID NO: 601355 - DNA, 507 bp, Homo sapiens; identical to SEQ ID NO: 588234
  misc_feature: HIJSMM301DF3O4.19.78.H01.1.454.light.4.raw

SEQ ID NO: 601356 - DNA, 509 bp, Homo sapiens
  misc_feature: HIJSMM301A3DB4.21.87.H10.1.454.light.4.raw
tcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaaactcttaatttctggcgtcaatcagcgaccctcacatgtttccagtcgattctctgcatccaagtctggcaacacggcctttctgacaatctctcaactccaggctgaagacgaggctatttattactgctcctcatacgcaggtggcacattttttcttggtttttggcggtcgggacccagatgactgtcctcagtcagcccaaggctgccccctcggt

SEQ ID NO: 601357 - DNA, 510 bp, Homo sapiens
  misc_feature: HIJSMM301ED1J7.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgttcgtccacgggaccgacacgtagaaatagagacgaactagtggcgtgcgaccactctgtcttctatcttcccgt

SEQ ID NO: 601358 - DNA, 508 bp, Homo sapiens
  misc_feature: HIJSMM301E17GY.17.28.C06.1.454.light.4.raw
cgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgacgtcctaagtcagcccaaggctgcccccc

SEQ ID NO: 601359 - DNA, 500 bp, Homo sapiens; identical to SEQ ID NO: 581055
  misc_feature: HIJSMM301A8405.15.1.A01.1.454.light.4.raw

SEQ ID NO: 601360 - DNA, 517 bp, Homo sapiens
  misc_feature: HIJSMM301D8RSG.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatacttgttccagcagctcccaggaacggcccccaaactcctcatctataggaataatcagcggccctcaggggtccctgaccgattctctggctccaaggctggcacctcagcctccctggccatcagtgggctccggtccgagggatgaggctgattattactgtgcagcatgggatgacagcctgagtggtccttgggtgttcggcggagggaccaagctgaccgtcctaagtcagcccaaggctgccccctcggtcactctcgttcccaccctcctcg

SEQ ID NO: 601361 - DNA, 504 bp, Homo sapiens
  misc_feature: HIJSMM301DCUZ8.10.27.C05.1.454.light.4.raw
catagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcagggtttctagtcgcttctctgcctccaagtctggcaacacggcctccctgacaatctctgggctccaggctgacgacgaggctgaatattactgcagctcatatgtagatggtgcctctttcaaggttttcggcggagggaccaggctgaccgtcctaagtcagcccaaggctgccccctcggt

SEQ ID NO: 601362 - DNA, 511 bp, Homo sapiens
  misc_feature: HIJSMM301BKWV5.41.53.E09.1.454.light.4.raw
tctatactatcacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggcggttataactatgtctcctggtaccaacaacacccaggcaaagtccccaaactcatgatttatgatgtcagtaatcggccctcaggggtttctaatcgcttctctggctccaagtctggcaatacggcctccctgacagtctctcggctccaggcggaggacgaggctgattactactgcttctcatatgcagatactaagtcctgggtgttcggcggagggaccaagctgaccgtcctaggtcagcccaaggctgccccctcggtcactctcg

SEQ ID NO: 601363 - DNA, 497 bp, Homo sapiens
  misc_feature: HIJSMM301D5N7I.9.53.E09.1.454.light.4.raw
tgatacgtctcacgaccggtgctcgatttagagagagtgtgttggggtttggggggggtcacagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctaggtcagcccaaggctg

SEQ ID NO: 601364 - DNA, 486 bp, Homo sapiens
  misc_feature: HIJSMM301CI27E.47.46.E02.1.454.light.4.raw
agctcacgtacacgaccggtgctcgatttagactcatctacagggaaaggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgcagtttattactgtcagcagtatcataactggccgctcaccttcggccaagggacacggactggagattaaacgaactgtggctgcgaccat

SEQ ID NO: 601365 - DNA, 460 bp, Homo sapiens
  misc_feature: HIJSMM301DU4WA.12.49.E05.1.454.light.4.raw
  modified_base (404)..(404): a, c, t, g, unknown or other
  modified_base (418)..(418): a, c, t, g, unknown or other
  modified_base (444)..(444): a, c, t, g, unknown or other
atacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagcaattttttagcctggtatcagcagaaaccaagggaaagttccacacctcctgatctatgctgcatccgctttgcaatcaggggtcccatctcggttcagcggcagtggatctgggacagagttcactctcaccatcagcagccttgcagcctgaagaatgttgnaacttattactgtnaaagtaataacaagtagccccttccnccttcgcacgagacac

SEQ ID NO: 601366 - DNA, 514 bp, Homo sapiens; identical to SEQ ID NO: 554167
  misc_feature: HIJSMM301DNNY9.40.12.B01.1.454.light.4.raw

SEQ ID NO: 601367 - DNA, 506 bp, Homo sapiens; identical to SEQ ID NO: 563474
  misc_feature: HIJSMM301EQFLT.10.27.C05.1.454.light.4.raw

SEQ ID NO: 601368 - DNA, 501 bp, Homo sapiens; identical to SEQ ID NO: 536867
  misc_feature: HIJSMM301BQ6L1.5.86.H09.1.454.light.4.raw

SEQ ID NO: 601369 - DNA, 507 bp, Homo sapiens; identical to SEQ ID NO: 535641
  misc_feature: HIJSMM301DURFU.10.88.H11.1.454.light.4.raw

SEQ ID NO: 601370 - DNA, 496 bp, Homo sapiens; identical to SEQ ID NO: 535109
  misc_feature: HIJSMM301AV0VF.16.78.H01.1.454.light.4.raw

SEQ ID NO: 601371 - DNA, 504 bp, Homo sapiens
  misc_feature: HIJSMM301EQ7XU.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgaggcggttgggtgttcgggcggagggaccaaactgaccgtcctaggtcagcccaa

SEQ ID NO: 601372 - DNA, 508 bp, Homo sapiens
  misc_feature: HIJSMM301EOEZG.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaactgaccgtcctaggtcagcccaaggctgccccctcggtcactctgttcccc

SEQ ID NO: 601373 - DNA, 494 bp, Homo sapiens; identical to SEQ ID NO: 534992
  misc_feature: HIJSMM301DY2LA.9.1.A01.1.454.light.4.raw

SEQ ID NO: 601374 - DNA, 489 bp, Homo sapiens
  misc_feature: HIJSMM301ERUWP.19.71.G05.1.454.light.4.raw
  modified_base (483)..(483): a, c, t, g, unknown or other
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggataatcanacgaaa

SEQ ID NO: 601375 - DNA, 499 bp, Homo sapiens
  misc_feature: HIJSMM301B6H4B.51.9.A09.1.454.light.4.raw
cgatcgtatacacgaccggtgctcgatttagcgagacgcgcaggggactgcgggggtaagaggttgtgtccaccatggcctggactcctctcctcctcctgttcctctcactgcacaggttccctctcgcaggctgtgctgactcagccgtcttccctgtctgcatctcctggagcatcagccagtctcacctgcaccttgcgcagtggcttcgatgttagtacctacaggatatactggttccagcagaaggcagggagtcctccccagtttctcctaaattacaaatctgactcacgtaagcagcagggctctggagtccccagccgcttctctggatccaaagatgcttcggccaatgcggggatttactcatctctgggctccagtctgaggatgaggctgactattactgtttgtatttggcacagcagcgcttgggtagttcggcggggggaccgaaactgaccgtcctaggtcagccaaggctgccccctcc

SEQ ID NO: 601376 - DNA, 499 bp, Homo sapiens
  misc_feature: HIJSMM301BI1BO.53.30.C08.1.454.light.4.raw
cgcgtatacacacgaccggtgctcgatttagtctgacgtcaaagggaaagggggggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactcgtcactctgtt

SEQ ID NO: 601377 - DNA, 490 bp, Homo sapiens
  misc_feature: HIJSMM301AF9ZV.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcaacaatattataataatccatttaatttcggcggagggaccaaggtggagatcaaacgactgtggctgcacatctgtcttcatcttcccgccta

SEQ ID NO: 601378 - DNA, 511 bp, Homo sapiens
  misc_feature: HIJSMM301D4UHH.43.23.C01.1.454.light.4.raw
tgtgagtagtcacgaccggtgctcgatttagtacacgtgattagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgaccatctctgggctccaggctgaggacgaggctgattattactgcaactcacttacaacgaccgacacttgcgtattcggcggcgggaccaagctgaccgtccaggtcagcccaaggctgccccctcggtcactc

SEQ ID NO: 601379 - DNA, 484 bp, Homo sapiens
  misc_feature: HIJSMM301B7YZ2.8.14.B03.1.454.light.4.raw
  modified_base (391)..(391): a, c, t, g, unknown or other
ctcgcgtgtccacgaccggtgctcgatttagtgtgagtagttccgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgcccagtggcatcaatttccatacctttagtgtatattggtatcagcagaagccagggagtcctccccactatctcctgaggtataaaacagactcagataaggagcaggcctctggagtccccagccgcttctctggatccaaagatgctgcggccaatgcagggagtttgctcatctctgggctccagtttnaggatgaggctgactattattgtatgatttggtacaggagcgcttgggtgatcggcggagggaccaagctgaccgtcctaggtcagcccaagg

SEQ ID NO: 601380 - DNA, 502 bp, Homo sapiens; identical to SEQ ID NO: 558110
  misc_feature: HIJSMM301A4QI6.4.6.A06.1.454.light.4.raw

SEQ ID NO: 601381 - DNA, 505 bp, Homo sapiens; identical to SEQ ID NO: 563772
  misc_feature: HIJSMM301A0V2U.21.22.B11.1.454.light.4.raw

SEQ ID NO: 601382 - DNA, 503 bp, Homo sapiens; identical to SEQ ID NO: 538884
  misc_feature: HIJSMM301ETTHH.27.78.H01.1.454.light.4.raw

SEQ ID NO: 601383 - DNA, 515 bp, Homo sapiens
  misc_feature: HIJSMM301B946Z.22.28.C06.1.454.light.4.raw
acatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttggtgttcggcggagggaccaggctgaccgtcctaggtcagcccaaggctgtccccccg

SEQ ID NO: 601384 - DNA, 487 bp, Homo sapiens; identical to SEQ ID NO: 568467
  misc_feature: HIJSMM301AZ5AH.51.73.G07.1.454.light.4.raw

SEQ ID NO: 601385 - DNA, 484 bp, Homo sapiens; identical to SEQ ID NO: 535240
  misc_feature: HIJSMM301BRARN.47.60.F05.1.454.light.4.raw

SEQ ID NO: 601386 - DNA, 492 bp, Homo sapiens; identical to SEQ ID NO: 550823
  misc_feature: HIJSMM301AE51K.49.20.B09.1.454.light.4.raw

SEQ ID NO: 601387 - DNA, 491 bp, Homo sapiens; identical to SEQ ID NO: 539402
  misc_feature: HIJSMM301BLUXJ.13.5.A05.1.454.light.4.raw

SEQ ID NO: 601388 - DNA, 487 bp, Homo sapiens
  misc_feature: HIJSMM301DWHPG.48.57.F02.1.454.light.4.raw
  modified_base (476)..(476): a, c, t, g, unknown or other
agtatacatacacgaccggtgctcgatttagctcgatatagttgggtttgggctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggngagggaccaag

SEQ ID NO: 601389 - DNA, 499 bp, Homo sapiens
  misc_feature: HIJSMM301A97AL.41.42.D09.1.454.light.4.raw
tctatactatcacgaccggtgctcgatttagacacatacgcagggaaagggggaggaactgctcagttaggacccagacggaaccatggaagccccagcgcagcttctcttcctcctgctactctggctcccagatgtcactggagaaatagtgatgacgcagtctccagccaccctgtctgtgtctccaggggaaagagccaccctctcctgcagggccagtcagagtcttagcggcaccttagcctggtaccagcagaaacctggccaggctcccaggctcctcatctatggtacatccaccagggtcactggtgttccagccaggttcagtggcagtgggtccgggacagagttcactctcaccatcagcagcctgcagtctgaagattttgcgatttattactgtcaccactataataattggccctccgcgtggacgttcggtcaggaccaaggtggaatcaaacgaactagtggctgcaccatctgtcttcta

SEQ ID NO: 601390 - DNA, 499 bp, Homo sapiens
  misc_feature: HIJSMM301BCWAW.43.53.E09.1.454.light.4.raw
tgtgagtagtcacgaccggtgctcgatttagagagagtgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtctaggtcagcccaaggccaacccta

SEQ ID NO: 601391 - DNA, 443 bp, Homo sapiens
  misc_feature: HIJSMM301B69G7.11.3.A03.1.454.light.4.raw
cgagagataccacgaccggtgctcgatttagagagcgtcacagggtacctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcgggcggagggacccacgtaaccgtcctaggtcagcccaaggctgccccctcggtcactctgttcccgccctcctcgtatctctcg

SEQ ID NO: 601392 - DNA, 507 bp, Homo sapiens; identical to SEQ ID NO: 561702
  misc_feature: HIJSMM301AFNCB.5.24.C02.1.454.light.4.raw

SEQ ID NO: 601393 - DNA, 496 bp, Homo sapiens
  misc_feature: HIJSMM301BKHZU.11.81.H04.1.454.light.4.raw
cgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcaggtgggtctgggacaggagttcactctcaccatcagcagcctgcagtctgaagattttgctagtttttactgtcagcagtatagtaactggcctccgtacacttttggccaggggaccaagctagaaatcaaacgaactgtggctgcaccatctgtcttca

SEQ ID NO: 601394 - DNA, 494 bp, Homo sapiens
  misc_feature: HIJSMM301AMWKB.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcccgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggagatcagacgaactgtggctgca

SEQ ID NO: 601395 - DNA, 482 bp, Homo sapiens
  misc_feature: HIJSMM301C25US.5.39.D06.1.454.light.4.raw
atcagacacgcacgaccggtgctcgatttagtgacatctcgcagttctttggggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatataatagttattggacgttcggccaggggaccaaggtcgaaatgagacgaactgtggctgcacca

SEQ ID NO: 601396 - DNA, 511 bp, Homo sapiens
  misc_feature: HIJSMM301EFDPI.17.41.D08.1.454.light.4.raw
cgtagactagcacgaccggtgctcgatttagtcacgcgagaaagggaaaggggagagaagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagtgtttttaaaaactatttagcctggtaccaacagaagcctggccaggctcccaggctcctcatctatggtgcatccaccagggccactggcatcccagacaggttcagtggcgtgggtctgggacagaattcactctcaccatcaccagtctggagcctgaagattttgctctgtatcactgtcagcaatatggtggtacaccccctcactttcgcggaggggccaaggtggagatcaaacgaactgtggctgcaccatctgtcttcatcttcccgcca

SEQ ID NO: 601397 - DNA, 491 bp, Homo sapiens; identical to SEQ ID NO: 549850
  misc_feature: HIJSMM301AW5QM.43.33.C11.1.454.light.4.raw

SEQ ID NO: 601398 - DNA, 450 bp, Homo sapiens
  misc_feature: HIJSMM301BDI4Y.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggcccaacccctctgtcactctcgttccccaccctcctccatactcgta

SEQ ID NO: 601399 - DNA, 383 bp, Homo sapiens; identical to SEQ ID NO: 447524
  misc_feature: HIJSMM301C8KSD.41.26.C04.1.454.light.4.raw

SEQ ID NO: 601400 - DNA, 454 bp, Homo sapiens; identical to SEQ ID NO: 535005
  misc_feature: HIJSMM301EM0AA.19.86.H09.1.454.light.4.raw

SEQ ID NO: 601401 - DNA, 487 bp, Homo sapiens; identical to SEQ ID NO: 536272
  misc_feature: HIJSMM301D6CFV.17.25.C03.1.454.light.4.raw

SEQ ID NO: 601402 - DNA, 481 bp, Homo sapiens
  misc_feature: HIJSMM301BYKKP.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtccatcaaggttcagtggcagtggatctgggacagatttcactctcaccatcaacagtctgcaacctgaagattttgcaacttactactgtcaacagagtttcactacccctctcactttcggcgggggaccgaaggtggagatcaaacgaactgtggctgcacc

SEQ ID NO: 601403 - DNA, 487 bp, Homo sapiens; identical to SEQ ID NO: 560173
  misc_feature: HIJSMM301BIZPY.47.70.G04.1.454.light.4.raw

SEQ ID NO: 601404 - DNA, 490 bp, Homo sapiens
  misc_feature: HIJSMM301BXWB2.52.68.G02.1.454.light.4.raw
cgcagtacgacacgaccggtgctcgatttagtcgatagtgaagggaaaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggcaccaacagtgattttggtggttatgattctgtcttctggtaccaacggcacccaggcaaagtccccaaactcatgattactgatatcaataagaggccctcaggggtccctgatcgcttctctggctccaagtctggcaacacggcctccctgaccatctctgggctccaggctgaggatgaggctgaatatttctgctgctcatatgcaggcggctacacttatgtcttcggaactgggacccaggtcaccgtcctaggtcagcccaagg

SEQ ID NO: 601405 - DNA, 500 bp, Homo sapiens; identical to SEQ ID NO: 546613
  misc_feature: HIJSMM301BQ1ZI.11.21.B10.1.454.light.4.raw

SEQ ID NO: 601406 - DNA, 506 bp, Homo sapiens; identical to SEQ ID NO: 567467
  misc_feature: HIJSMM301BEPQM.7.71.G05.1.454.light.4.raw

SEQ ID NO: 601407 - DNA, 447 bp, Homo sapiens; identical to SEQ ID NO: 535201
  misc_feature: HIJSMM301C4NJR.18.9.A09.1.454.light.4.raw

SEQ ID NO: 601408 - DNA, 507 bp, Homo sapiens
  misc_feature: HIJSMM301BRU5T.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggagatcaaacgaactagtggctgcaccatctgtcttcatcttcccgtccat

SEQ ID NO: 601409 - DNA, 499 bp, Homo sapiens
  misc_feature: HIJSMM301D4TTY.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcgggtcagagttcactctcaccatcagcagcctgcagtctgaagtattttgctagtttattactgtcagcagtatgatacctcggcctccgtactacgtttcggtccgggggaccaagctggaaatcgaagcgaactgtggctgcaccatctgtcttcatt

SEQ ID NO: 601410 - DNA, 384 bp, Homo sapiens
  misc_feature: HIJSMM301DHIG8.41.26.C04.1.454.light.4.raw
tctatactatcacgaccggtgctcgatttagtctagcgactttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatacaaacgaactgtggctgcaccatctgtcttcatcttcccgccatctgaatagtataga

SEQ ID NO: 601411 - DNA, 480 bp, Homo sapiens
  misc_feature: HIJSMM301EO4YA.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcggccctgggaccaaagtggatatcaaacgaactgtgctgcaccat

SEQ ID NO: 601412 - DNA, 500 bp, Homo sapiens
  misc_feature: HIJSMM301EXZWC.12.26.C04.1.454.light.4.raw
atacgacgtacacgaccggtgctcgatttagtctagcgactttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttattcaactccaacaatgagaactacttagcttggtaccagcagaaaccaggacagccgcccaagttgctcatttactgggcatctacccgggaatccggggtccctgaccgattcagtggcagcgggtctgagacagatttcactctcaccatcagcagcctgcaggccgaagatgtggcagtttatttttgtcagcaatattatcatactccgctcactttcggcggagggaccaaggtggagatcaaacgaactgtgggctgcacc

SEQ ID NO: 601413 - DNA, 486 bp, Homo sapiens
  misc_feature: HIJSMM301DSSOQ.46.26.C04.1.454.light.4.raw
  modified_base (416)..(416): a, c, t, g, unknown or other
  modified_base (446)..(446): a, c, t, g, unknown or other
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctnttattgcatgcaagctctacaagtccccgntcactttcggcggagggaccaaggtggaggatcaaacgaa

SEQ ID NO: 601414 - DNA, 486 bp, Homo sapiens; identical to SEQ ID NO: 535043
  misc_feature: HIJSMM301DXNX4.46.35.D02.1.454.light.4.raw

SEQ ID NO: 601415 - DNA, 454 bp, Homo sapiens; identical to SEQ ID NO: 586569
  misc_feature: HIJSMM301A7RPZ.19.86.H09.1.454.light.4.raw
  modified_base (429)..(429): a, c, t, g, unknown or other

SEQ ID NO: 601416 - DNA, 521 bp, Homo sapiens; identical to SEQ ID NO: 538715
  misc_feature: HIJSMM301DAT5Y.27.23.C01.1.454.light.4.raw

SEQ ID NO: 601417 - DNA, 504 bp, Homo sapiens; identical to SEQ ID NO: 537659
  misc_feature: HIJSMM301AM8DY.13.55.E11.1.454.light.4.raw

SEQ ID NO: 601418 - DNA, 510 bp, Homo sapiens
  misc_feature: HIJSMM301COE2T.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagacgaactagtggctgcaccatctgtcttcatcttcccgcc

SEQ ID NO: 601419 - DNA, 504 bp, Homo sapiens
  misc_feature: HIJSMM301ETIP6.41.45.E01.1.454.light.4.raw
tctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttattcgggtgttcggcggggggaccgaagctgaccgtcctaggtcagcccaaggctgccccctcggtcactctcg

SEQ ID NO: 601420 - DNA, 501 bp, Homo sapiens; identical to SEQ ID NO: 573090
  misc_feature: HIJSMM301C8NSX.18.11.A11.1.454.light.4.raw

SEQ ID NO: 601421 - DNA, 492 bp, Homo sapiens; identical to SEQ ID NO: 537666
  misc_feature: HIJSMM301BCAT1.43.33.C11.1.454.light.4.raw

SEQ ID NO: 601422 - DNA, 459 bp, Homo sapiens; identical to SEQ ID NO: 555098
  misc_feature: HIJSMM301EVTKP.22.28.C06.1.454.light.4.raw

SEQ ID NO: 601423 - DNA, 503 bp, Homo sapiens
  misc_feature: HIJSMM301B79P4.22.20.B09.1.454.light.4.raw
acatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccaggggaaagagccaccctctcgtgtaaggccagtcagaatgttaacaacagatatgtagcctggtatcagcagagacctggccagtctcccgttctcctcgtctttggtgcggccgacagggccacgggcatccctgacagattcagtggcaggtgggtccgggtcagactatctgctcaccatcggcggtctggaacctgaagattctgcactatattactgtcagctttattgttaattcacctccgtcgtacatctttggccaggggaccaagcctggagatcaaacgaactgtggctgcaccatctgtcttcattccc

SEQ ID NO: 601424 - DNA, 437 bp, Homo sapiens
  misc_feature: HIJSMM301EJMKY.17.11.A11.1.454.light.4.raw
cgtagactagcacgaccggtgctcgatttagctacgactgcggggtctctgcatctagtagggccgatctctgcgctcctgacggtgctcgcctttatccatttttccaggtcctccacgtcctcctcttcttcctcccatctgttccatcaaaggtccagggggccccccagggccacctcgtcttcctccaccaaagccacctcggtccatgccccggccaccacggaagccacctctgtctccaccacggccacctctgaacattccaccgggaccaccacgatccatgaggccacctcttcctccccgcatgccaccagggccacctctgccacgatcaccacccgggggcggaaagggtggcgggaggaagccttcaggctttggggccttacactggttgcactctgttcccgccctcctcctagtctacg

SEQ ID NO: 601425 - DNA, 477 bp, Homo sapiens
  misc_feature: HIJSMM301CC9TO.41.5.A05.1.454.light.4.raw
tctatactatcacgaccggtgctcgatttagatagatagacaggggcaggagtcagacccagtcaggacacagcatggacatgagggtccccgctcagctcctgggctcctgctgctctggttcccaggttccagatgcgacatccagctgacccagtctccatcttctgtgtctgcatctgtaggagacagagtcaacatcacttgtcgggcgagtcagggtattaccagctggttagcctggtatcagcagaaaccagggaaagccctaaactcctgatctatgctgcatccagtttgcaaagtggggtcccatcaagattcagaggcagtggatctgggacagatttcactctcactatcaacagcctgcagcctgaagattttgccacttactattgtcaacaggctgacagtttccccttcaccttcggccaagggacacgactggacattaacgaactgtggctgcaccta

SEQ ID NO: 601426 - DNA, 512 bp, Homo sapiens
  misc_feature: HIJSMM301C5MS1.17.2.A02.1.454.light.4.raw
  modified_base (438)..(438): a, c, t, g, unknown or other
cgtagactagcacgaccggtgctcgatttagactcatctacagggggggtagagaagacaggactcaggacaatctccagcatggccagcttccctctcctcctcaccctcctcactcactgtgcagggtcctgggcccagtctgtactgactcagccaccctcagcgtctgggacccccggacagagggtcaccatctcttgttctggaagcagctccaacatcgggactaatactgtaacctggttccagcacgtcccaggaacggcccccaaactcgtcatgtataattatagtcagcggccctcaggggtccctgaccgattcgctggctccaactctggcacctcagcctccctggccatcagtgggctccagtctgaggatgaggctgattattactgtgcagcatgggatgccagcctgagtagtcccgtnttcggaactgggaccaaggtcaccgtctacgtcagcccaaggcccaaccccactgtcactctcgttcccgccct

SEQ ID NO: 601427 - DNA, 503 bp, Homo sapiens; identical to SEQ ID NO: 559148
  misc_feature: HIJSMM301BE32U.7.31.C09.1.454.light.4.raw

SEQ ID NO: 601428 - DNA, 489 bp, Homo sapiens
  misc_feature: HIJSMM301COAEC.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatccaccaggggccaccggtatcccagccaggttcagtggcagtgggtctggggacagagttcactctcaccatcagcagcctgcagtctgaggattttgcagtttattactgtcagcattacaataactggcctcggctcactttcggcggagggaccaaggtggagatacaaacgaactgtggctgcaccat

SEQ ID NO: 601429 - DNA, 510 bp, Homo sapiens
  misc_feature: HIJSMM301BDSP0.13.73.G07.1.454.light.4.raw
tcacgtactacacgaccggtgctcgatttagctctacgctcaggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaactcattatttacggggtcaataagcggccctcagggctttctgatcgcttctctggctccaagtctggcaacacggcctccctgacaatctctggactccaggccgaggacgaggctgatttttactgttgttcatatgcaggaaggagtgatttatgtctttggaagtgggaccaaggtcaccgtcctggtcagcccaaggccaaccccactgtcactctgttccca

SEQ ID NO: 601430 - DNA, 514 bp, Homo sapiens
  misc_feature: HIJSMM301BNMPQ.48.63.F08.1.454.light.4.raw
agtatacatacacgaccggtgctcgatttagcgatcgtataagggggagtcagacccagtcaggacacagcatggacatgagggtccccgctcagctcctggggctcctgctgctctggctcccaggtgccgagtgtgacatccagatgacccagtttccttccgccctgtctgcatctgtgggagacagagtcaccatcacttgtcgggccagtcagagtgttaataagtggttggcctggtatcagcagaaacccgggaaagcccctaacctcctaatctatgaggcatctactctacaaagtggagtcccatccaggttcagcggcagtgcatctgggaccgacttcagtctcaccatcagcagcctgcaccctgatgattttgcaacttattactgtcaacaatattatacttacccgtacacttttggcctagggactaagctggagatcaaacgacgtaacgtggtcgtcgtcgaccaactcttcgttcttccttactctttcccccg

SEQ ID NO: 601431 - DNA, 514 bp, Homo sapiens
  misc_feature: HIJSMM301A501N.51.27.C05.1.454.light.4.raw
cgatcgtatacacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaggcaaagcccccaaactcatgatttatgatgtcagtgatcggccctcaggggtttcgaatcgcttctctggctccaagtccggcaacacggcctccctgaccatctctgggctccaggccgaggacgaggctgattattactgcacctcatatacaagcagcaacaattgggtgttcggcggagggaccaagctgaccgtcctaggtcagcccaaggctcgccccctcggtcactctcgtt

SEQ ID NO: 601432 - DNA, 481 bp, Homo sapiens; identical to SEQ ID NO: 535993
  misc_feature: HIJSMM301A5UOC.21.25.C03.1.454.light.4.raw

SEQ ID NO: 601433 - DNA, 506 bp, Homo sapiens; identical to SEQ ID NO: 551204
  misc_feature: HIJSMM301DENW1.15.59.F04.1.454.light.4.raw

SEQ ID NO: 601434 - DNA, 469 bp, Homo sapiens; identical to SEQ ID NO: 595670
  misc_feature: HIJSMM301CFK44.11.70.G04.1.454.light.4.raw

SEQ ID NO: 601435 - DNA, 488 bp, Homo sapiens; identical to SEQ ID NO: 538017
  misc_feature: HIJSMM301BD1JL.4.59.F04.1.454.light.4.raw

SEQ ID NO: 601436 - DNA, 511 bp, Homo sapiens; identical to SEQ ID NO: 546062
  misc_feature: HIJSMM301CESSQ.5.58.F03.1.454.light.4.raw

SEQ ID NO: 601437 - DNA, 486 bp, Homo sapiens; identical to SEQ ID NO: 536261
  misc_feature: HIJSMM301ADV7S.26.55.E11.1.454.light.4.raw

SEQ ID NO: 601438 - DNA, 503 bp, Homo sapiens
  misc_feature: HIJSMM301ATSLG.7.5.A05.1.454.light.4.raw
cgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttctagggtttccgtaactcgtcttctctggctccaagtctggcgacacggcctccctcgaccatctctgggctccaggctgaagacgaggctgattattactgcagctcatatacaggcagcagcactcaggttttcggtcgggagggaccaagctgaccgtcctaggtcagccaaggctgccccctcggt

SEQ ID NO: 601439 - DNA, 487 bp, Homo sapiens; identical to SEQ ID NO: 541583
  misc_feature: HIJSMM301BXQB2.41.57.F02.1.454.light.4.raw

SEQ ID NO: 601440 - DNA, 514 bp, Homo sapiens; identical to SEQ ID NO: 547648
  misc_feature: HIJSMM301AHUU1.16.1.A01.1.454.light.4.raw

SEQ ID NO: 601441 - DNA, 509 bp, Homo sapiens
  misc_feature: HIJSMM301CBF7F.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatggggacagacttcactctcaccatcatcagcctggagcctgaggatgttgcagtttattactgtcaacatcgtaccgagtggcctccgggggccactttcggccctgggaccaaagtggatatcaaacgaactgtggctgcaccatctgtcttcta

SEQ ID NO: 601442 - DNA, 494 bp, Homo sapiens; identical to SEQ ID NO: 535478
  misc_feature: HIJSMM301ASC0C.10.79.H02.1.454.light.4.raw

SEQ ID NO: 601443 - DNA, 512 bp, Homo sapiens
  misc_feature: HIJSMM301C6GAQ.41.30.C08.1.454.light.4.raw
tctatactatcacgaccggtgctcgatttagtctgacgtcaaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgattaccatctcctgctctgggatcaacagcgaccttggtggttataactatgtgtcctggtaccaacaatatccaggcaaacccccaaagtcatcatttatgatgtcggtagtcggccctccggggtctctagtcgcttctctggctccaagtctggcaacacggcctccctgaccatctctgggctccaggctgaggacgaggctgactattactgcagttcatatacaagcagcagcactggagtcttcggaactgggaccagggtcaccgtcctaggtcagcccaaggcccaacccactgtcactctgtt

SEQ ID NO: 601444 - DNA, 502 bp, Homo sapiens; identical to SEQ ID NO: 536253
  misc_feature: HIJSMM301EWWC3.21.22.B11.1.454.light.4.raw

SEQ ID NO: 601445 - DNA, 507 bp, Homo sapiens
  misc_feature: HIJSMM301EN5G6.40.16.B05.1.454.light.4.raw
  modified_base (434)..(434): a, c, t, g, unknown or other
tctagcgactcacgaccggtgctcgatttagagctcacgtaagggggtctcaggaggcagcactctcgggacgtctccaccatggcctgggccctgctcctcctcagcctcctcactcagggcacaggatcctggactcagtctgccctgactcagcctcgctcagtgtccgggtctcctggacagtcagtcaccctctcctgcactggaaccagcagtaatgttggtggttataactttgtctcctggtaccaacaccacccaggcaaagcccccaaattcttgatttatgatgtcaataagcggccctcaggggtccctgatcgcttctctggctccaagtctggcaacacggcctccctgaccatctctgggctccaggctgaggatgaggctgattattactgctgctcatttgcaggtagtttttgggngtttcggcggagggaccaagctgaccgtcctaggtcagcccaaggctgccccctggtcactctgttcccacct

SEQ ID NO: 601446 - DNA, 509 bp, Homo sapiens
  misc_feature: HIJSMM301DOQB1.13.4.A04.1.454.light.4.raw
tcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccaggaccctggagcctcagttggaagcagccgatccagcctgcggagcctgtgggcaggtcagcccaaggccaacccactgtcactctgtt

SEQ ID NO: 601447 - DNA, 490 bp, Homo sapiens
  misc_feature: HIJSMM301C1GBO.4.40.D07.1.454.light.4.raw
agcactgtagcacgaccggtgctcgatttagtgatagagcgtaacaacagagggggagctgctcagttaggacccagaggcaaccatggaaaccccagcgcagcttctcttcctcctgctactctgactcccagataccacaggagaagttgtgttgacgcagtctccaggcaccctgtctttgtctccaggggagagggccaccctctcctgcaggaccagtcagagtgataccaacaactttttagcctggtaccaacagaaagctggccaggctcccaggctcctcatctatggtgcatccatcagggccactggcatcccagacaggttcagtggcagtgggtctgggacagacttcactctcatcatcaacagactggagcctgaggattctgcagtgtattactgtcaccagtatggtggggcgcgcgttttcggcgggggaccgaaggtggacatcaaacgaactgtggctgcaccatctgtt

SEQ ID NO: 601448 - DNA, 496 bp, Homo sapiens; identical to SEQ ID NO: 538149
  misc_feature: HIJSMM301DWK9H.13.67.G01.1.454.light.4.raw

SEQ ID NO: 601449 - DNA, 488 bp, Homo sapiens
  misc_feature: HIJSMM301CNGE8.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcaggtggcagtgggtctgggacagacttcactctcaccatcagcagactggagcctgaagattttgcagtctattactgtcagcagtatggtcacgtacccaagaactttggccaggggaccaagctggagatcaaacgaactgtggcttgcaccat

SEQ ID NO: 601450 - DNA, 517 bp, Homo sapiens
  misc_feature: HIJSMM301AUN37.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccaccctcctccc

SEQ ID NO: 601451 - DNA, 496 bp, Homo sapiens
  misc_feature: HIJSMM301AT96E.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtactacttttggccaggggaccaagctggagatcaaacgactgtggctgcaccatctgt

SEQ ID NO: 601452 - DNA, 489 bp, Homo sapiens
  misc_feature: HIJSMM301CBX7Z.16.68.G02.1.454.light.4.raw
  modified_base (466)..(466): a, c, t, g, unknown or other
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtgagggaccaaggtggaggtcaaacgaacngtgctgcaccatctgtcttcatt

SEQ ID NO: 601453 - DNA, 498 bp, Homo sapiens
  misc_feature: HIJSMM301B8VPA.10.37.D04.1.454.light.4.raw
catagtagtgcacgaccggtgctcgatttagtagcatactgttgggtttgggggctctggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaagcctggccaggttcccagactcctcatatatgaagcctcttccagggccactggagtcccagccaggttcagcggcggtgggtctgggacagacttcactctcaccatcagcagcctgcagtctgaggaccttggagtttattactgtcagcagtatcataactggcctccgtggacgtcggccaacgggaccaaggtggacctacaaacgaactgtggctgcaccat

SEQ ID NO: 601454 - DNA, 487 bp, Homo sapiens
  misc_feature: HIJSMM301BO7QX.49.34.D01.1.454.light.4.raw
agtcgagagacacgaccggtgctcgatttagatcgtctgtgttgggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccgagggtggagatacaaaacg

SEQ ID NO: 601455 - DNA, 519 bp, Homo sapiens
  misc_feature: HIJSMM301AI6U1.40.46.E02.1.454.light.4.raw
tctagcgactcacgaccggtgctcgatttagactcatctacagggaaagggggggcctaaggaagcagcactggtggtgcctcagccatggcctggaccgttctcctcctcggcctcctctctcactgcacagggtctgtgacctcctatgtgctgactcagccactctcggtgtctgtggccccaggacaggcggccaatgttacctgtgggggagacaacattgggagtaaaagtgtgcactggtaccagctgaagccaggccaggcccctgtgttggtcgtctttggacatggtgcccgaccctcggggatccctgagcgattctctgcctccaggtctgggaacacggccaccctgaccatcaccagggtcgaggccggagatgaggccgactatttttgtcacgtgtggcacgttagtcatcacgtcttcggaactgggaccacggtcaccgtcctaagtcagcccaaggccaaccccactgtcactctgttcccgccctcctcagtcgctaga

SEQ ID NO: 601456 - DNA, 497 bp, Homo sapiens
  misc_feature: HIJSMM301DB41M.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaactggtggctgcaccatctgt

SEQ ID NO: 601457 - DNA, 505 bp, Homo sapiens
  misc_feature: HIJSMM301B7EV4.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagccaaggctcgccccctcggtcta

SEQ ID NO: 601458 - DNA, 522 bp, Homo sapiens
  misc_feature: HIJSMM301ARSLV.41.55.E11.1.454.light.4.raw
tctatactatcacgaccggtgctcgatttagcactcgcacgttgggtttgggggggcctaaggaagcagcactggtggtgcctcagccatggcctggaccgttctcctcctcggcctcctctctcactgcacagcctctgtgacctcctatgtgttgactcagccaccctcggcgtcagtggccctaggacagacggccaggattacctgtggggcaaataagataggaactacaaatgtgcactggtaccaacagaggccaggccaggcccctgtggtggtcgtccatgatgattacgaccggccctcaggaatccctgagcgattctctggctccaattctgggaacacggccaccctgaccatcaccggggtcgaggccggggatgaggccacctactattgtcacgtctgggagactggtgatgatcctgtggcgctattcggcggagggacgaagctgaccgtcctgggtcagcccaaggctgccccctcggtcactctcgttcccgccctcctcta

SEQ ID NO: 601459 - DNA, 496 bp, Homo sapiens; identical to SEQ ID NO: 537925
  misc_feature: HIJSMM301DF06E.22.14.B03.1.454.light.4.raw

SEQ ID NO: 601460 - DNA, 441 bp, Homo sapiens; identical to SEQ ID NO: 534971
  misc_feature: HIJSMM301EFZHM.11.3.A03.1.454.light.4.raw

SEQ ID NO: 601461 - DNA, 501 bp, Homo sapiens
  misc_feature: HIJSMM301BFYJ6.7.31.C09.1.454.light.4.raw
cgtgtctctacacgaccggtgctcgatttagacgtctcatcaaggaaggaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataagtatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaagatgaggctgattattactgctgctcatatgcaggccgcaacagtgatctattcggcggagggaccaagctgaccgtctaggtcagccaaggctgccccctc

SEQ ID NO: 601462 - DNA, 495 bp, Homo sapiens; identical to SEQ ID NO: 539809
  misc_feature: HIJSMM301CE1QN.3.33.C11.1.454.light.4.raw

SEQ ID NO: 601463 - DNA, 497 bp, Homo sapiens; identical to SEQ ID NO: 540619
  misc_feature: HIJSMM301CN5VP.15.25.C03.1.454.light.4.raw

SEQ ID NO: 601464 - DNA, 513 bp, Homo sapiens
  misc_feature: HIJSMM301BRSKD.17.37.D04.1.454.light.4.raw
cgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctgtgggggaacaatgttggaagtaaaactgtgcactggtaccagcagaagccaggccaggcccctgtgctggtcgtctatgatgataccgaccggccctcagggatccctgagcgattctctggctccaactctgggaacacggccaccctgaccatcggcagggtcgaagccggggatgaggccgactattattgtcaggtgtgggatagtagtagtgatcatgtggtattcggcggagggaccaagctgaccgtccttggtcagcccaaggctgccccctcggtcactctgttcccgccct

SEQ ID NO: 601465 - DNA, 479 bp, Homo sapiens
  misc_feature: HIJSMM301AWRH3.11.17.B06.1.454.light.4.raw
cgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaacagagttacagtaccccgtggacgttcggccaaggaccgaaggtggaaatacaaacgaactagtggctgca

SEQ ID NO: 601466 - DNA, 516 bp, Homo sapiens
  misc_feature: HIJSMM301EBJPV.10.38.D05.1.454.light.4.raw
catagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttggcggcgggactaaggtgaccgtcctgggtcagcccaaggctgccccctcggtcactctgtcccgcct

SEQ ID NO: 601467 - DNA, 501 bp, Homo sapiens; identical to SEQ ID NO: 573085
  misc_feature: HIJSMM301AP40Y.48.78.H01.1.454.light.4.raw

SEQ ID NO: 601468 - DNA, 501 bp, Homo sapiens; identical to SEQ ID NO: 546428
  misc_feature: HIJSMM301CZGWY.48.8.A08.1.454.light.4.raw

SEQ ID NO: 601469 - DNA, 507 bp, Homo sapiens
  misc_feature: HIJSMM301BZ7OB.40.16.B05.1.454.light.4.raw
tctagcgactcacgaccggtgctcgatttagagctcacgtaaggggggggtcgtcaggaggcagcactctcgggacgtctccaccatggcctgggctctgctcctcctcagcctcctcactcagggcacaggatcctggactcagtctgccctgactcagcctcgctcagtgtccgggtctcctggacagtcagtcaccctctcctgcactggaaccagcagtaatgttggtggttataactttgtctcctggtaccaacaccacccaggcaaagcccccaaattcttgatttatgatgtcaataagcggccctcaggggtccctgatcgcttctctggctccaagtctggcaacacggcctccctgaccatctctgggctccaggctgaggatgaggctgattattactgctgctcatttgcaggtagtttttgggtgttcggcggagggaccaaggctgaccgtctaggtcagcccaaggctgccccctggtcactctgttccca

SEQ ID NO: 601470 - DNA, 497 bp, Homo sapiens; identical to SEQ ID NO: 536371
  misc_feature: HIJSMM301DJXMI.16.78.H01.1.454.light.4.raw

SEQ ID NO: 601471 - DNA, 488 bp, Homo sapiens; identical to SEQ ID NO: 576475
  misc_feature: HIJSMM301A91ST.3.55.E11.1.454.light.4.raw

SEQ ID NO: 601472 - DNA, 462 bp, Homo sapiens; identical to SEQ ID NO: 542058
  misc_feature: HIJSMM301ATZK6.48.23.C01.1.454.light.4.raw

SEQ ID NO: 601473 - DNA, 514 bp, Homo sapiens; identical to SEQ ID NO: 597680
  misc_feature: HIJSMM301BF57H.22.36.D03.1.454.light.4.raw

SEQ ID NO: 601474 - DNA, 489 bp, Homo sapiens; identical to SEQ ID NO: 535139
  misc_feature: HIJSMM301AKSFG.14.55.E11.1.454.light.4.raw

SEQ ID NO: 601475 - DNA, 510 bp, Homo sapiens; identical to SEQ ID NO: 566324
  misc_feature: HIJSMM301BWKW6.5.60.F05.1.454.light.4.raw

SEQ ID NO: 601476 - DNA, 490 bp, Homo sapiens; identical to SEQ ID NO: 538999
  misc_feature: HIJSMM301BIOSA.16.86.H09.1.454.light.4.raw

SEQ ID NO: 601477 - DNA, 493 bp, Homo sapiens; identical to SEQ ID NO: 535084
  misc_feature: HIJSMM301DZHJ3.47.64.F09.1.454.light.4.raw

SEQ ID NO: 601478 - DNA, 494 bp, Homo sapiens; identical to SEQ ID NO: 535828
  misc_feature: HIJSMM301BXY23.3.36.D03.1.454.light.4.raw

SEQ ID NO: 601479 - DNA, 505 bp, Homo sapiens
  misc_feature: HIJSMM301EWN3G.8.34.D01.1.454.light.4.raw
ctcgcgtgtccacgaccggtgctcgatttagatcgtctgtgttgggtttgggggaggaactgctcagttaggacccagagggaaccatggaagccccagctcggcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccggggccactttcggccctgggaccaaagtggatatcaaacgaactgtggctgcaccatctgtcttc

SEQ ID NO: 601480 - DNA, 519 bp, Homo sapiens
  misc_feature: HIJSMM301ENLPQ.40.53.E09.1.454.light.4.raw
tctagcgactcacgaccggtgctcgatttagagagagtgtgttgggtttgggggggtagagaagacaggactcaggacaatctccagcatggccagcttccctctcctcctcaccctcctcactcactgtgcagggtcctgggcccagtctgtgctgactcagccaccctcagcgtctgggacccccggtcagagggtcaccatctcttgttctggaagcagatccaacatcggaagtaatactgtaaactggtaccagcagctcccaggaacggcccccaaactcctcatctatgataatagtcaccggccctcaggggtacctgaccgattctctggctccaagtctggcacctcagcctccctggccatcagtgggctccagtctgaggatgaggctgattatcactgtgcatcctgggatgacagcctgaatggttgggtggtttcggcgggggaccgaagctcgaccgtcctaacgtcagcccaacggctcgccccctccggtcgactccttcg

SEQ ID NO: 601481 - DNA, 497 bp, Homo sapiens; identical to SEQ ID NO: 539058
  misc_feature: HIJSMM301A6GYS.12.87.H10.1.454.light.4.raw

SEQ ID NO: 601482 - DNA, 505 bp, Homo sapiens; identical to SEQ ID NO: 547173
  misc_feature: HIJSMM301BWL2Y.8.28.C06.1.454.light.4.raw

SEQ ID NO: 601483 - DNA, 503 bp, Homo sapiens
  misc_feature: HIJSMM301CJ045.7.31.C09.1.454.light.4.raw
cgtgtctctacacgaccggtgctcgatttagacgtctcatcaaggaaggaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataagtatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaagatgaggctgattattactgctgctcatatgcaggccgcaacagtgatctattcggcggagggaccaaggctgaccgtcctaggtcagcccaaggctgcccctc

SEQ ID NO: 601484 - DNA, 508 bp, Homo sapiens; identical to SEQ ID NO: 535835
  misc_feature: HIJSMM301D6FVK.8.34.D01.1.454.light.4.raw

SEQ ID NO: 601485 - DNA, 510 bp, Homo sapiens
  misc_feature: HIJSMM301BNXGN.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccgaagggaccgaaggtaggaaagtacaaacgaactagtggctggcaccactctgtcttcatcttccccg

SEQ ID NO: 601486 - DNA, 506 bp, Homo sapiens
  misc_feature: HIJSMM301CDBP5.17.28.C06.1.454.light.4.raw
cgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattatactgtgcaccgtgggatgacatcctgaatggtccggtgttcggcggaggaccaggctgaccgtcctaagtcagcccaaggctgccccc

SEQ ID NO: 601487 - DNA, 512 bp, Homo sapiens
  misc_feature: HIJSMM301DAKRZ.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtgtgttcggcggagggaccaagctggccgtcctaggtcagcccaaggctgccccctggtcactctgttcccgccctcctcgagtagtaca

SEQ ID NO: 601488 - DNA, 510 bp, Homo sapiens
  misc_feature: HIJSMM301DUL32.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctcgggaccaaggtggagatcaaacgaactgtggctgcaccatctgtcttctac

SEQ ID NO: 601489 - DNA, 509 bp, Homo sapiens; identical to SEQ ID NO: 541829
  misc_feature: HIJSMM301C3BR9.17.28.C06.1.454.light.4.raw

SEQ ID NO: 601490 - DNA, 518 bp, Homo sapiens
  misc_feature: HIJSMM301BS3IT.51.27.C05.1.454.light.4.raw
cgatcgtatacacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaggcaaagcccccaaactcatgatttatgatgtcagtgatcggccctcaggggtttcgaatcgcttctctggctccaagtccggcaacacggcctccctgaccatctctgggctccaggccgaggacgaggctgattattactgcacctcatatacaagcagcaacaattgggtgttcggcggagggaccaagctgaccgtcctaggtcagcccaaggctgccccctcggtcattctcgttccccg

SEQ ID NO: 601491 - DNA, 525 bp, Homo sapiens
  misc_feature: HIJSMM301EOMHF.40.27.C05.1.454.light.4.raw
tctagcgactcacgaccggtgctcgatttagacgcgatcgaagggtttgggggtggagaagacaggattcaggccaatctccagcatggccggcttccctctcctcctcaccctcctcactcactgtgcagggtcctgggcccagtctgtgctgactcagccaccctcagcgtctgagacccccgggcagcaggttaccgtctcttgttctggaagcagctccaacatcggaagtaattctgtatactggtaccagtgcctcccaggaacggcccccaaacttctcgtctatagggattatcagcggcccttaggggtccctgaccgattctctggctccaggtctggcacctcagcctccctggccatcagtgggctccggcccgaggatgaggcggattattattgtgtgtcatgggatgacagaatgaatggtccggtgttcggcggagggaccaggctgaccgtcctaggtcagcccaaggctgccccctcggtcactctgttcccaccctcctcagtcgc

SEQ ID NO: 601492 - DNA, 517 bp, Homo sapiens
  misc_feature: HIJSMM301AZUE8.9.25.C03.1.454.light.4.raw
tgatacgtctcacgaccggtgctcgatttagtagtgtagatttgggtttggggctgggcctaaggaagcagcactggtggtgcctcagccatggcctggaccgttctcctcctcggcctcctctctcactgcacagtctttgtagactctgtgaccttccatgtgctgactcagccaccctcggtgtcagtggcccctggaaagacggccagcataacctgtgagggagacaacattaaaacaaataatgtgcattggtaccagcagaagccaggccaggcccctgtcctggtcgtctttgatgatagtgaccggccctcagggatccctgagcgattctctggctccaactctgggaacacggccaccctgaccatcagcggggtcgaagccggggatgaggccgactatttctgtcagctgtgggattctcatgatggtaggtgggggaatcgttcggcggagggaccaggctgaccgtcctaagtcagcccaaggctcgccccctcggtcactc

SEQ ID NO: 601493 - DNA, 492 bp, Homo sapiens; identical to SEQ ID NO: 565833
  misc_feature: HIJSMM301A3SH6.16.68.G02.1.454.light.4.raw

SEQ ID NO: 601494 - DNA, 507 bp, Homo sapiens; identical to SEQ ID NO: 535641
  misc_feature: HIJSMM301ARJE9.10.88.H11.1.454.light.4.raw

SEQ ID NO: 601495 - DNA, 512 bp, Homo sapiens; identical to SEQ ID NO: 550704
  misc_feature: HIJSMM301BTTOZ.15.76.G10.1.454.light.4.raw

SEQ ID NO: 601496 - DNA, 494 bp, Homo sapiens; identical to SEQ ID NO: 535276
  misc_feature: HIJSMM301CFWOP.16.6.A06.1.454.light.4.raw

SEQ ID NO: 601497 - DNA, 490 bp, Homo sapiens
  misc_feature: HIJSMM301DADNP.16.78.H01.1.454.light.4.raw
  modified_base (428)..(428): a, c, t, g, unknown or other
  modified_base (458)..(459): a, c, t, g, unknown or other
  modified_base (464)..(464): a, c, t, g, unknown or other
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataattaacgngcctccacgtacacttgcgacggacgaagnngaganacaaacgaactgtgctgcaaccatct

SEQ ID NO: 601498 - DNA, 505 bp, Homo sapiens; identical to SEQ ID NO: 551816
  misc_feature: HIJSMM301DMVJJ.18.78.H01.1.454.light.4.raw

SEQ ID NO: 601499 - DNA, 497 bp, Homo sapiens
  misc_feature: HIJSMM301DW76A.51.39.D06.1.454.light.4.raw
cgatcgtatacacgaccggtgctcgatttagtgacatctcgcagttctttgggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccaacagaagccaggccaggcccctgtgttgttgatatataaagacagtgagaggccttcagggatccctgagcgattctctggctccacctcagggacactggtcacattgaccatcagtggagtccaggcagaagacgaggctgactatttctgtcaatcttcagacgtcagtggtacttatgtcttcggaactgggaccaaggtcaccgtcctaggtcagcccaaggccaacccactgtcactc

SEQ ID NO: 601500 - DNA, 502 bp, Homo sapiens
  misc_feature: HIJSMM301BSVSD.5.86.H09.1.454.light.4.raw
atcagacacgcacgaccggtgctcgatttagtgctatagacttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagccaaggctgccccctcgtcta

SEQ ID NO: 601501 - DNA, 493 bp, Homo sapiens
  misc_feature: HIJSMM301DUVET.49.71.G05.1.454.light.4.raw
agtcgagagacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtca

SEQ ID NO: 601502 - DNA, 505 bp, Homo sapiens
  misc_feature: HIJSMM301EB69U.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtggaaagtacaaacgaactagtggctgcaccactctgtcttcatttcccgt

SEQ ID NO: 601503 - DNA, 492 bp, Homo sapiens
  misc_feature: HIJSMM301DR67J.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcagggtggaggctgaggatgtggggtttgttcctccatgcaaggtacacactggccttttggccaggggaccaacctggagatcaaatgaactgtggctgcaccatctgtctt

SEQ ID NO: 601504 - DNA, 503 bp, Homo sapiens; identical to SEQ ID NO: 540136
  misc_feature: HIJSMM301DZ07R.19.10.A10.1.454.light.4.raw

SEQ ID NO: 601505 - DNA, 485 bp, Homo sapiens; identical to SEQ ID NO: 535606
  misc_feature: HIJSMM301DLAYN.47.46.E02.1.454.light.4.raw

SEQ ID NO: 601506 - DNA, 493 bp, Homo sapiens
  misc_feature: HIJSMM301CVRN5.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggccccatctccaaggcgcctaatttataagctttctaaccgggactctggggtcccagacagattcagcggcagtggcactgatgtcacactgacaatcagcagggtggaggctgaggatgttgggtttgttcctccatgcaaggtacacactggccttttggccaggggaccaacctggagatcaaatgaactgtggctgcaccatctgtctt

SEQ ID NO: 601507 - DNA, 444 bp, Homo sapiens; identical to SEQ ID NO: 544367
  misc_feature: HIJSMM301DDAE4.2.76.G10.1.454.light.4.raw

SEQ ID NO: 601508 - DNA, 489 bp, Homo sapiens
  misc_feature: HIJSMM301C8K5T.14.53.E09.1.454.light.4.raw
cgtctagtaccacgaccggtgctcgatttagagagagtgtgttgggtttgggggggagcctagctgtgctgtgggtccgaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcggggtgttcggcggaggggaccaagctgaccgtccta

SEQ ID NO: 601509 - DNA, 486 bp, Homo sapiens; identical to SEQ ID NO: 535043
  misc_feature: HIJSMM301AOCFN.46.35.D02.1.454.light.4.raw

SEQ ID NO: 601510 - DNA, 482 bp, Homo sapiens
  misc_feature: HIJSMM301A7F7P.52.53.E09.1.454.light.4.raw
  modified_base (435)..(435): a, c, t, g, unknown or other
cgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcagggggacgtatccctgatcgcttctcaggctccggctctgggactgagcgctacctcaccatctccagcctccagtctgaggacgagggtgactattactgtcagacgtgggacactggcatttgggngttcggcggagggaccaagttgaccgtctaggtcagcccaaggctcg

SEQ ID NO: 601511 - DNA, 480 bp, Homo sapiens
  misc_feature: HIJSMM301AW5PP.22.29.C07.1.454.light.4.raw
  modified_base (460)..(460): a, c, t, g, unknown or other
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgtcgtcaggacgaacggtaggagtanaacgaaacagtgcgtgcaca

SEQ ID NO: 601512 - DNA, 503 bp, Homo sapiens; identical to SEQ ID NO: 536834
  misc_feature: HIJSMM301AE4UB.2.35.D02.1.454.light.4.raw

SEQ ID NO: 601513 - DNA, 487 bp, Homo sapiens
  misc_feature: HIJSMM301BL4PH.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggccctcgggacaactagtggatatcaaacgaaactagtggcgtgcaccatctgtt

SEQ ID NO: 601514 - DNA, 495 bp, Homo sapiens; identical to SEQ ID NO: 544003
  misc_feature: HIJSMM301A73I3.3.31.C09.1.454.light.4.raw

SEQ ID NO: 601515 - DNA, 504 bp, Homo sapiens; identical to SEQ ID NO: 538940
  misc_feature: HIJSMM301EE304.2.35.D02.1.454.light.4.raw

SEQ ID NO: 601516 - DNA, 497 bp, Homo sapiens
  misc_feature: HIJSMM301C9S7W.3.31.C09.1.454.light.4.raw
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcaactacttagcctggtaccaacagaaacctggccaggctcccaggctcctcatctatgatgcatccaacagggccactggcactcccagccaggttcagtggcagtgggtctgggacagacttcactctcaccatcagcagcctagagcctgaagattttgcagtttattactgtcagcagcgtagcaactggcctctcactttcggcggagggaccgaaggtggagatcaaacgaactgtggctgcaccatctgtctt

SEQ ID NO: 601517 - DNA, 502 bp, Homo sapiens
  misc_feature: HIJSMM301BKRU2.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtctaggtcagcccaaggccaaccccactg

SEQ ID NO: 601518 - DNA, 477 bp, Homo sapiens; identical to SEQ ID NO: 537678
  misc_feature: HIJSMM301C4622.12.1.A01.1.454.light.4.raw

SEQ ID NO: 601519 - DNA, 495 bp, Homo sapiens; identical to SEQ ID NO: 545900
  misc_feature: HIJSMM301B4R96.11.59.F04.1.454.light.4.raw

SEQ ID NO: 601520 - DNA, 502 bp, Homo sapiens; identical to SEQ ID NO: 536253
  misc_feature: HIJSMM301AI54U.21.22.B11.1.454.light.4.raw

SEQ ID NO: 601521 - DNA, 492 bp, Homo sapiens; identical to SEQ ID NO: 564874
  misc_feature: HIJSMM301BA96K.11.25.C03.1.454.light.4.raw

SEQ ID NO: 601522 - DNA, 500 bp, Homo sapiens; identical to SEQ ID NO: 540836
  misc_feature: HIJSMM301BBJ1Q.3.10.A10.1.454.light.4.raw

SEQ ID NO: 601523 - DNA, 498 bp, Homo sapiens; identical to SEQ ID NO: 544837
  misc_feature: HIJSMM301DK21H.11.71.G05.1.454.light.4.raw

SEQ ID NO: 601524 - DNA, 514 bp, Homo sapiens; identical to SEQ ID NO: 541418
  misc_feature: HIJSMM301AI9XC.17.33.C11.1.454.light.4.raw

SEQ ID NO: 601525 - DNA, 516 bp, Homo sapiens; identical to SEQ ID NO: 595651
  misc_feature: HIJSMM301A8WSH.22.36.D03.1.454.light.4.raw

SEQ ID NO: 601526 - DNA, 485 bp, Homo sapiens; identical to SEQ ID NO: 536075
  misc_feature: HIJSMM301A412O.17.21.B10.1.454.light.4.raw

SEQ ID NO: 601527 - DNA, 483 bp, Homo sapiens; identical to SEQ ID NO: 564488
  misc_feature: HIJSMM301BIQOS.51.41.D08.1.454.light.4.raw

SEQ ID NO: 601528 - DNA, 478 bp, Homo sapiens
  misc_feature: HIJSMM301C3P2C.3.20.B09.1.454.light.4.raw
agacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcgtctatttaaattggtatcagcacaaaccagggaaagcccctaagctcctgatctatgctgaatccactttgcaaagtggggtcccatcaaggttcagtggcagtggatctgggacagatttcactctaaccatcagcggtctgcaacctgaagattttgcaactcactactgtcaacagagtgacagcacgcctcacactttcggcggagggaccaaaggtggagatacaaacgaactagtggctg

SEQ ID NO: 601529 - DNA, 514 bp, Homo sapiens
  misc_feature: HIJSMM301A38MD.17.33.C11.1.454.light.4.raw
  modified_base (507)..(507): a, c, t, g, unknown or other
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctcgttcccnccctcct

SEQ ID NO: 601530 - DNA, 477 bp, Homo sapiens
  misc_feature: HIJSMM301DNZ75.52.73.G07.1.454.light.4.raw
cgcagtacgacacgaccggtgctcgatttagctctacgctcagggggatcaggactcctcagttcaccttctcacaatgaggctccctgctcagctcctggggctgctaatgctctgggtctctggatccagtggggagattgtgatgactcagtctccactctccctgcccgtcacccctggagagacggcctccatctcctgcaggtctagtcagagcctcctgcatagtaatggatacaagtatttggattggtatctgcagaagccagggcagtctccacagctcctgatctatttgggttctaatcgggcctccggggtccctgagaggttcagtggcagtggatcaggcacagattttacactaaaaatcagcagagtggaggctgaggatgttggggtttattactgcatgcaagttctacaaaatcctacgcacttttggccaggggaccaagctggagatcaaacgaa

SEQ ID NO: 601531 - DNA, 497 bp, Homo sapiens; identical to SEQ ID NO: 551301
  misc_feature: HIJSMM301BH1LK.15.81.H04.1.454.light.4.raw

SEQ ID NO: 601532 - DNA, 474 bp, Homo sapiens
  misc_feature: HIJSMM301BG3VJ.49.4.A04.1.454.light.4.raw
agtcgagagacacgaccggtgctcgatttagagtagtgatcagggggcaggagtcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttctaccatcagcaggctgcagcctgaagatattgcaacatattactgtcaacagtatgatcgcctcccgctcactttcggcgggggaccgacggtaggaggatcaagacgactagt

SEQ ID NO: 601533 - DNA, 454 bp, Homo sapiens; identical to SEQ ID NO: 535005
  misc_feature: HIJSMM301C4DT9.19.86.H09.1.454.light.4.raw

SEQ ID NO: 601534 - DNA, 492 bp, Homo sapiens; identical to SEQ ID NO: 541650
  misc_feature: HIJSMM301BQ0VZ.5.57.F02.1.454.light.4.raw

SEQ ID NO: 601535 - DNA, 484 bp, Homo sapiens
  misc_feature: HIJSMM301DAAPB.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggaggaccaagctgaccgtcctgcgtcagcccaaggctgccccctcggtcactctgttcccgccctcctcgctacgtaga

SEQ ID NO: 601536 - DNA, 515 bp, Homo sapiens
  misc_feature: HIJSMM301C1QWA.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccgaagggaccgaaggtaggaaagtacaaaacgaaacctagtggcgtgcaccaatctgtcttcactcttccccg

SEQ ID NO: 601537 - DNA, 492 bp, Homo sapiens; identical to SEQ ID NO: 538644
  misc_feature: HIJSMM301DCFY1.26.78.H01.1.454.light.4.raw

SEQ ID NO: 601538 - DNA, 517 bp, Homo sapiens
  misc_feature: HIJSMM301CHIC3.13.55.E11.1.454.light.4.raw
tcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtggccccgggacagacggccacaattccctgtgagggaaacaaccttagaagtcagaatgtccactggtaccagcagaagtcaggccaggcccctgtggtggtcatctatagggataataaccggccctctgggatccctgaccgattctctggctccaactcggggaacacggccaccctgaccatcaacagagcccaagacggggatgaggctgactattattgtcaggtgtgggacagcaccacggtgatattcggcggcgggaccaagctgaccgtcctaggtcagcccaaggctgccccctcggtcactctcgttcccaccctcctct

SEQ ID NO: 601539 - DNA, 500 bp, Homo sapiens; identical to SEQ ID NO: 551915
  misc_feature: HIJSMM301A7BO2.18.11.A11.1.454.light.4.raw

SEQ ID NO: 601540 - DNA, 493 bp, Homo sapiens; identical to SEQ ID NO: 535745
  misc_feature: HIJSMM301ENLF4.47.78.H01.1.454.light.4.raw

SEQ ID NO: 601541 - DNA, 486 bp, Homo sapiens
  misc_feature: HIJSMM301C6STA.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcatgcacagattttacactgaaaatcagcagagtggaggctgaggatgttgggctctattattgcatgcaagctctacaagtcccgctcactttcggcggaggaccaaggtggagatcaaacgtaacg

SEQ ID NO: 601542 - DNA, 407 bp, Homo sapiens; identical to SEQ ID NO: 536776
  misc_feature: HIJSMM301CQ83J.40.8.A08.1.454.light.4.raw

SEQ ID NO: 601543 - DNA, 515 bp, Homo sapiens
  misc_feature: HIJSMM301AITBB.4.21.B10.1.454.light.4.raw
agcactgtagcacgaccggtgctcgatttagtgtcgtcgcaagagagagagaggaggggggggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccacttgactatcagtggggcccaagtggaggatgaagctgactactactgttactcaatagagaacagtgataatttctgggttgttcggcggagggaccaaactcgaccgtcctaggtcacgcccgaaggctcgccccctcggtccacttccg

SEQ ID NO: 601544 - DNA, 511 bp, Homo sapiens; identical to SEQ ID NO: 549837
  misc_feature: HIJSMM301A9XXN.15.34.D01.1.454.light.4.raw

SEQ ID NO: 601545 - DNA, 422 bp, Homo sapiens; identical to SEQ ID NO: 539229
  misc_feature: HIJSMM301CV28N.41.15.B04.1.454.light.4.raw

SEQ ID NO: 601546 - DNA, 511 bp, Homo sapiens; identical to SEQ ID NO: 544123
  misc_feature: HIJSMM301DY785.5.27.C05.1.454.light.4.raw

SEQ ID NO: 601547 - DNA, 486 bp, Homo sapiens; identical to SEQ ID NO: 548936
  misc_feature: HIJSMM301DL12N.5.55.E11.1.454.light.4.raw

SEQ ID NO: 601548 - DNA, 488 bp, Homo sapiens; identical to SEQ ID NO: 535725
  misc_feature: HIJSMM301D0T2K.12.88.H11.1.454.light.4.raw

SEQ ID NO: 601549 - DNA, 485 bp, Homo sapiens
  misc_feature: HIJSMM301D6K6X.22.6.A06.1.454.light.4.raw
acatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgctttttggtatcaacagaggccaggccacgcccctgtcttaatgatatataaagacagtgagaggccctcagggatctctgagcgattctctgcctccagctcagggacaacattcacattgaccatcagtgaagtccaggcagaagatgaggctgactattattgtcaatcaacagacagtagtgggaaatatgtggtattcgggcggagggaccaaactgaccgtccaggtcagcccaaggctcgcccccg

SEQ ID NO: 601550 - DNA, 507 bp, Homo sapiens; identical to SEQ ID NO: 535316
  misc_feature: HIJSMM301AD9ZD.18.37.D04.1.454.light.4.raw

SEQ ID NO: 601551 - DNA, 489 bp, Homo sapiens
  misc_feature: HIJSMM301D4OTZ.13.46.E02.1.454.light.4.raw
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattggggctctattattgcatgcaagcaacacactggccgtacacttttggccaggggaccaagctggagatcaatcgaact

SEQ ID NO: 601552 - DNA, 500 bp, Homo sapiens
  misc_feature: HIJSMM301CROES.43.55.E11.1.454.light.4.raw
tgtgagtagtcacgaccggtgctcgatttagcactcgcacgttgggtttggggagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaaagtggggtcccattaaggttcagcggcagtggatctgggacagagtttactctcaccatcagcagcctgcagcctgatgattttgcaacttattactgccaacaatatgattcttggccgtggatgttcggccaagggaccaacgtggaaatcaaacgaactgtggctgcaccatctgttcttcattccttccccg

SEQ ID NO: 601553 - DNA, 464 bp, Homo sapiens; identical to SEQ ID NO: 537214
  misc_feature: HIJSMM301AWVD0.18.59.F04.1.454.light.4.raw

SEQ ID NO: 601554 - DNA, 513 bp, Homo sapiens; identical to SEQ ID NO: 545752
  misc_feature: HIJSMM301D7OF6.17.33.C11.1.454.light.4.raw

SEQ ID NO: 601555 - DNA, 494 bp, Homo sapiens; identical to SEQ ID NO: 535828
  misc_feature: HIJSMM301CM53E.3.36.D03.1.454.light.4.raw

SEQ ID NO: 601556 - DNA, 444 bp, Homo sapiens; identical to SEQ ID NO: 535856
  misc_feature: HIJSMM301DRPRY.9.9.A09.1.454.light.4.raw

SEQ ID NO: 601557 - DNA, 487 bp, Homo sapiens
  misc_feature: HIJSMM301BJBVT.13.33.C11.1.454.light.4.raw
tcacgtactacacgaccggtgctcgatttagagtgagctcgttgggtttggggctgggcctcaggaagcagcatcgggggtgccgcagccatggcctggaccgctctcctgctgagcctccttgctcactttacagcttctgtggcctcctatgagttgactcagccactctcagtgtcagtggccccgggacagacggccacaattccctgtgagggaaacaaccttagaagtcagaatgtccactggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactggaccaaggtcaccgtcctaagtcagcccaaggccaa

SEQ ID NO: 601558 - DNA, 495 bp, Homo sapiens; identical to SEQ ID NO: 545183
  misc_feature: HIJSMM301E2GYX.16.10.A10.1.454.light.4.raw

SEQ ID NO: 601559 - DNA, 503 bp, Homo sapiens
  misc_feature: HIJSMM301A2XX2.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacaccggcctccctgaccatctctgggctccaggctgaggacgaggctgattattactgcagctcatatacaagcaccagcactctctatgtcttcggaactgggaccaaggtcaccgtcctaggtcagcccaaggccaaccca

SEQ ID NO: 601560 - DNA, 444 bp, Homo sapiens; identical to SEQ ID NO: 587149
  misc_feature: HIJSMM301AXVEO.17.21.B10.1.454.light.4.raw

SEQ ID NO: 601561 - DNA, 498 bp, Homo sapiens
  misc_feature: HIJSMM301A1UX9.40.36.D03.1.454.light.4.raw
tctagcgactcacgaccggtgctcgatttagctgcgtcacgatctctcttgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtcttttatacaactccaacaagcagcactacttagcttggtaccagcagaaaccaggacagcctcctaaactgctcatttactgggcctctacccgggaatccggggtccctgaccgattcagtggcagcgggtctgggacagatttcactctgaccatcagcagcctgcaggctgaagatgtggcagtttattactgtcagcacttggttttggcggttctccgtactttcggcggagggaccgaaggtggaggtacaaacgaactgtgg

SEQ ID NO: 601562 - DNA, 491 bp, Homo sapiens
  misc_feature: HIJSMM301AQQ11.4.64.F09.1.454.light.4.raw
agcactgtagcacgaccggtgctcgatttagcgcgtatacaaggggggagtcagacccagtcaggacacagcgtggacatgagggtccccgctcagctcctggggctcctgctgctctggttcccaggttccagatgcgacatccagatgacccagtctccatcttccgtgtctgcatctgtgggcgacagagtcaccatcacttgtcgggcgagtcaggacattgggacccgattagcctggtatcagcagaaaccagggaaagcccctaacctcctcatctatgctgcgtccagtttgcacagtggggtcccattgaggttcagcggcagtggttctgagacagatttcagtctcaccatccgtgacctgcagcctgaagattttgcaacttacttttgtcaacagactaactcattccctcgcagttttggccaggggaccaaggtggagatcaaacgaactgtggctgcaccatctgtcttcattcc

SEQ ID NO: 601563 - DNA, 496 bp, Homo sapiens
  misc_feature: HIJSMM301D12IO.52.78.H01.1.454.light.4.raw
cgcagtacgacacgaccggtgctcgatttagtgtgagtagtttgggtttgggggtgggtccaggaggcagaactctgggtgtctcaccatggcctggatccctctacttctcccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcgagggaccaagctgaccgtctaggtcagcccaaggctgcccctcggtcactc

SEQ ID NO: 601564 - DNA, 508 bp, Homo sapiens; identical to SEQ ID NO: 553356
  misc_feature: HIJSMM301AH9DK.3.79.H02.1.454.light.4.raw

SEQ ID NO: 601565 - DNA, 493 bp, Homo sapiens; identical to SEQ ID NO: 561962
  misc_feature: HIJSMM301B9I7B.41.2.A02.1.454.light.4.raw

SEQ ID NO: 601566 - DNA, 504 bp, Homo sapiens; identical to SEQ ID NO: 539091
  misc_feature: HIJSMM301CLMX5.8.28.C06.1.454.light.4.raw

SEQ ID NO: 601567 - DNA, 470 bp, Homo sapiens
  misc_feature: HIJSMM301AXZ70.15.81.H04.1.454.light.4.raw
tctacgtagccacgaccggtgctcgatttagtagtgtagattcgcggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcagggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgcccctcggtcactctgttcccaccctcctcgctacgtaga

SEQ ID NO: 601568 - DNA, 506 bp, Homo sapiens
  misc_feature: HIJSMM301BOO24.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcaggcccaaggccaaccccatgtca

SEQ ID NO: 601569 - DNA, 502 bp, Homo sapiens
  misc_feature: HIJSMM301D7YDZ.3.21.B10.1.454.light.4.raw
  modified_base (430)..(430): a, c, t, g, unknown or other
agacgcactccacgaccggtgctcgatttagtgtcgtcgcaagagagggggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaaacaaccggccctcagggatcccagaccgattctctggctccagctcaaggaaacacagcttccttgaccatcactggggctcaggcggaagatgaggctgactatactgtaactcccgggccagcagtggtaacattgngatattcggcggagggaccaaaggtgaccgtcctacgtcagcccaaaggctgccccctcggtccactctgtt

SEQ ID NO: 601570 - DNA, 496 bp, Homo sapiens
  misc_feature: HIJSMM301DCXOP.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccagggtggaggatacaaacgaaactgtggctgcaccatctgtcttcatt

SEQ ID NO: 601571 - DNA, 495 bp, Homo sapiens; identical to SEQ ID NO: 537415
  misc_feature: HIJSMM301ATAVM.4.27.C05.1.454.light.4.raw

SEQ ID NO: 601572 - DNA, 353 bp, Homo sapiens; identical to SEQ ID NO: 536338
  misc_feature: HIJSMM301EN369.3.11.A11.1.454.light.4.raw

SEQ ID NO: 601573 - DNA, 496 bp, Homo sapiens; identical to SEQ ID NO: 589148
  misc_feature: HIJSMM301A9UP7.16.10.A10.1.454.light.4.raw

SEQ ID NO: 601574 - DNA, 507 bp, Homo sapiens
  misc_feature: HIJSMM301DWFAP.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggccaagggaccgaaggtggaaatacaaacgaactagtggcgtgcaccatctgtcttcatcttccccg

SEQ ID NO: 601575 - DNA, 483 bp, Homo sapiens
  misc_feature: HIJSMM301DQZJ2.3.50.E06.1.454.light.4.raw
agacgcactccacgaccggtgctcgatttagatctactgacaacacacaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggggacagagtcaccatcacttgccgggcaagtcagagtattagcaggtatttaaattggtatcagcaaaaaccagggaaagcccctaaacttttgatctatgctgcatccagtttgcaaagtggggtcccatcaaggttcaatggcagtggatctgggacagatttcactctcaccatcagcagtctacagcctgaagattttgcaacttactactgtcaacagagttacagtacttggtatttcactttcggccctgggaccaaagtggacatcaaacgaactgtgg

SEQ ID NO: 601576 - DNA, 515 bp, Homo sapiens
  misc_feature: HIJSMM301DE448.9.14.B03.1.454.light.4.raw
tgatacgtctcacgaccggtgctcgatttagtgtgagtagttccgcgggggtgggctcaggaggcagagctctgggaatctcaccatggcctggacccctctcctgctccccctcctcactttctgcacagtctctgaggcctcctatgatctgacacagccaccctcggtgtcagtgtccccaggacagacggccaggatcacctgctctggagatggattatcaaaaaaatatgtttattggtaccaacagaagtcaggccaggccccccttctagtcatctatgaggacgccaggcgaccctccgggatccctgagagaatctcgggctccagttcagggacagtggccaccttgacgatcggtgggcccaggtggaagatgaagctgactacttctgttactcaacagacgacagtgcggatcatagagggatgttcggcggagggaccaagctgaccgtcctaggtcagcccaaggcctgccccctcggtcactctgttcccaccctcct

SEQ ID NO: 601577 - DNA, 507 bp, Homo sapiens
  misc_feature: HIJSMM301CS7UY.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagcccaaggctgccccctcggtctacc

SEQ ID NO: 601578 - DNA, 501 bp, Homo sapiens; identical to SEQ ID NO: 536142
  misc_feature: HIJSMM301EJ1P6.15.1.A01.1.454.light.4.raw

SEQ ID NO: 601579 - DNA, 520 bp, Homo sapiens; identical to SEQ ID NO: 539176
  misc_feature: HIJSMM301CRURA.27.23.C01.1.454.light.4.raw

SEQ ID NO: 601580 - DNA, 516 bp, Homo sapiens
  misc_feature: HIJSMM301DKPJB.10.86.H09.1.454.light.4.raw
catagtagtgcacgaccggtgctcgatttagtgctatagacttggggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggctttcggcggagggactaagttgaccgtcctacgtcagccaaggctgccccctcggtcactctgttcccaccctcctccactactatg

SEQ ID NO: 601581 - DNA, 490 bp, Homo sapiens
  misc_feature: HIJSMM301DHM7A.16.68.G02.1.454.light.4.raw
  modified_base (482)..(482): a, c, t, g, unknown or other
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaactgtggctgcaccatcngtcttcat

SEQ ID NO: 601582 - DNA, 499 bp, Homo sapiens
  misc_feature: HIJSMM301AZC77.40.57.F02.1.454.light.4.raw
tctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttatttttgtctgctcttatgcaggcagtttcgctctcgaagtgttcggcggagggaccgagctgaccgtcctacgtcagcccaaggctcg

SEQ ID NO: 601583 - DNA, 488 bp, Homo sapiens
  misc_feature: HIJSMM301D197M.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacacgtacccccctcactttcggcggaggaccgaaggcggagatcagacgaactgtgctgcaccatctgtcttct

SEQ ID NO: 601584 - DNA, 505 bp, Homo sapiens; identical to SEQ ID NO: 599576
  misc_feature: HIJSMM301DDWTH.48.41.D08.1.454.light.4.raw

SEQ ID NO: 601585 - DNA, 487 bp, Homo sapiens; identical to SEQ ID NO: 540841
  misc_feature: HIJSMM301DFSG1.4.33.C11.1.454.light.4.raw

SEQ ID NO: 601586 - DNA, 503 bp, Homo sapiens; identical to SEQ ID NO: 573795
  misc_feature: HIJSMM301A44NS.13.55.E11.1.454.light.4.raw

SEQ ID NO: 601587 - DNA, 503 bp, Homo sapiens; identical to SEQ ID NO: 567708
  misc_feature: HIJSMM301AN6WZ.21.81.H04.1.454.light.4.raw

SEQ ID NO: 601588 - DNA, 500 bp, Homo sapiens
  misc_feature: HIJSMM301A19YA.43.71.G05.1.454.light.4.raw
tgtgagtagtcacgaccggtgctcgatttagtgtcgtcgcaagagagaggggcacgaccggtgctcgatttagtgtcgtcgcaagagagaggggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacga

SEQ ID NO: 601589 - DNA, 483 bp, Homo sapiens
  misc_feature: HIJSMM301DER7I.4.71.G05.1.454.light.4.raw
agcactgtagcacgaccggtgctcgatttagtgtcgtcgcaagagagagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccgccatcagctgcaagtccagccagagtgttttattcagctccaacaataagaactacttagcttggtaccagcagaaaccaggacagcctcctaacctgctcatttactgggcatctacccgggaatccggggtccctgaccgattcagtggcagcgggtctgggacagatttcactctcaccatcaacagcctgcaggctgaagatgtggcagtttattactgtcagcagtattaatataactccttcactttcggcggagggaccaaggtggagatcaaacgaa

SEQ ID NO: 601590 - DNA, 503 bp, Homo sapiens; identical to SEQ ID NO: 543938
  misc_feature: HIJSMM301BXKV0.4.71.G05.1.454.light.4.raw

SEQ ID NO: 601591 - DNA, 486 bp, Homo sapiens; identical to SEQ ID NO: 535043
  misc_feature: HIJSMM301DBVS5.46.35.D02.1.454.light.4.raw

SEQ ID NO: 601592 - DNA, 510 bp, Homo sapiens
  misc_feature: HIJSMM301EW3RM.40.16.B05.1.454.light.4.raw
tctagcgactcacgaccggtgctcgatttagagctcacgtaagggggtctcaggaggcagcactctcgggacgtctccaccatggcctgggccctgctcctcctcagcctcctcactcagggcacaggatcctggactcagtctgccctgactcagcctcgctcagtgtccgggtctcctggacagtcagtcaccctctcctgcactggaaccagcagtaatgttggtggttataactttgtctcctggtaccaacaccacccaggcaaagcccccaaattcttgatttatgatgtcaataagcggccctcaggggtccctgatcgcttctctggctccaagtctggcaacacggcctccctgaccatctctgggctccaggctgaggatgaggctgattattactgctgctcatttgcaggtagtttttgggtgttcggcggtagggaccaagctgaccgtcctaggtcagcccaaggctgccccctcggtcactctgttccccctctc

SEQ ID NO: 601593 - DNA, 463 bp, Homo sapiens
  misc_feature: HIJSMM301DVSSB.13.4.A04.1.454.light.4.raw
tcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacagggtcccatcaaggttcagtggaagtggatctgggacagattttactttcaccatcagcagcctgcagcctgaagatattgcaacatattactgtcagcagtatgataatctccgatcaccttcggccaagggacacgactggagattaacgaa

SEQ ID NO: 601594 - DNA, 444 bp, Homo sapiens; identical to SEQ ID NO: 535192
  misc_feature: HIJSMM301ENFBI.5.9.A09.1.454.light.4.raw

SEQ ID NO: 601595 - DNA, 510 bp, Homo sapiens
  misc_feature: HIJSMM301EDJAC.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcggataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggccgtccgggggccactttcggccctcgggaccgaaagtggatatacaaacgaactgtggctgcaccatctgtctt

SEQ ID NO: 601596 - DNA, 502 bp, Homo sapiens
  misc_feature: HIJSMM301BYINY.15.26.C04.1.454.light.4.raw
tctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaagcccctaacctcctaatctatgatgcctccagtttggagagtggggtcccatctaggttcagcggcagtggatttgggacagaattcactctcaccatccgcagcctgcagcctgaagattttgcaacttattactgccaacagtataatagcaattctccgtggacgttcggtccaagggaccgagggtgggagtattcaaacgaactacgtggctgcaccatctgtcttcatt

SEQ ID NO: 601597 - DNA, 513 bp, Homo sapiens; identical to SEQ ID NO: 545752
  misc_feature: HIJSMM301AILOB.17.33.C11.1.454.light.4.raw

SEQ ID NO: 601598 - DNA, 501 bp, Homo sapiens; identical to SEQ ID NO: 535746
  misc_feature: HIJSMM301APFGV.18.11.A11.1.454.light.4.raw

SEQ ID NO: 601599 - DNA, 473 bp, Homo sapiens
  misc_feature: HIJSMM301C1E6C.15.8.A08.1.454.light.4.raw
tctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagccctcccaggctcctcatctatgctgcatccattagggacactggtatcccagccaggttcagtggcagtgggtctggcacagagttcactctcaccatcagcagcccgcagtctgaagattttgcagtttattactgtcagcaatataacaagtggccattcactttcggcccagggaccaaagtggatatcaaacgaactgtggctgcaccatctgtcttcatcttcccgccat

SEQ ID NO: 601600 - DNA, 496 bp, Homo sapiens; identical to SEQ ID NO: 548177
  misc_feature: HIJSMM301DIQWF.18.59.F04.1.454.light.4.raw

SEQ ID NO: 601601 - DNA, 497 bp, Homo sapiens
  misc_feature: HIJSMM301DPJ82.14.64.F09.1.454.light.4.raw
cgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgatccagtctccatcctccctgtctgcatctgtaggagacagagtcaccatcacttgccggacaagtcagagcgttatcgcctatttaaattggtatcagcaaaaaccagggaaagcccctaacctcctgatctttgatgcatccaatttgcagagtggggtcccatcacgcttcactggcagtggctctgggacagatttcactctcaccatcagcggtctccaacctgaagattttgcaacttactactgtcaacagagttatgataccccgtggacgttcggccaggggaccgaaggtggagatcaaacgaactgtggctgcaccatctgtcttctatcttccccg

SEQ ID NO: 601602 - DNA, 508 bp, Homo sapiens
  misc_feature: HIJSMM301AIFKL.40.41.D08.1.454.light.4.raw
tctagcgactcacgaccggtgctcgatttagtcacgcgagaaagggaaaggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactccccatgtggtattcggcggagggaccaagctgaccgtcctaggtcagcccaaggctgccccccg

SEQ ID NO: 601603 - DNA, 501 bp, Homo sapiens; identical to SEQ ID NO: 550139
  misc_feature: HIJSMM301B6V4N.15.56.F01.1.454.light.4.raw

SEQ ID NO: 601604 - DNA, 495 bp, Homo sapiens; identical to SEQ ID NO: 536827
  misc_feature: HIJSMM301BHPWP.48.63.F08.1.454.light.4.raw

SEQ ID NO: 601605 - DNA, 491 bp, Homo sapiens
  misc_feature: HIJSMM301D78LO.40.20.B09.1.454.light.4.raw
tctagcgactcacgaccggtgctcgatttagtgtagtgtgaagggggggcctcaggaagccgcatcggaggtgcctcagccatggcatggatccctctcttcctcggcgtccttgcttactgcacaggatccgtggcctcctctgagttgactcagccaccctcagtgtccgtgtcccccggacagacagccagcatcacgtgctcaggagatgatttgaacaataaacatgcttgttggtatcaacagaaaccaggccagtcccctgttctggtcatctttgaggattcaaagcggccctcagggatccctgagcgattctctggctccaagtctgcgctcacagccactctgaccatcagcgggacccagcctatggatgaggctgactattattgtcagtcgtgggacagcagcacctcttcctatgtcttcggaactgggacccaggtcaccgtcctcggtcagcccaaggccaaccccactgtcta

SEQ ID NO: 601606 - DNA, 491 bp, Homo sapiens
  misc_feature: HIJSMM301AIHP8.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcaggtgggtctgggacagacttcactctcaccatcagcagactggagcctgaagtattttgcagtcttattactgtcagcagtatggtcacgtcccaagtaactttggccgaggggaccaagctggagatacaaacgaactgtggctgcaccat

SEQ ID NO: 601607 - DNA, 493 bp, Homo sapiens
  misc_feature: HIJSMM301AEBY4.9.12.B01.1.454.light.4.raw
tgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttgccaggaccaacggtggaatcaacgaactgtggctgcacca

SEQ ID NO: 601608 - DNA, 501 bp, Homo sapiens; identical to SEQ ID NO: 569143
  misc_feature: HIJSMM301D4KJG.18.59.F04.1.454.light.4.raw

SEQ ID NO: 601609 - DNA, 491 bp, Homo sapiens
  misc_feature: HIJSMM301CYAUO.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatggttggggtttattactgcatgcaagctctacaaactccttactacttttggccaggggaccaagctggagatcaaacgaact

SEQ ID NO: 601610 - DNA, 489 bp, Homo sapiens; identical to SEQ ID NO: 543840
  misc_feature: HIJSMM301EXK4O.12.88.H11.1.454.light.4.raw

SEQ ID NO: 601611 - DNA, 491 bp, Homo sapiens; identical to SEQ ID NO: 559129
  misc_feature: HIJSMM301CJHM3.10.20.B09.1.454.light.4.raw

SEQ ID NO: 601612 - DNA, 470 bp, Homo sapiens; identical to SEQ ID NO: 550855
  misc_feature: HIJSMM301AJG7X.3.82.H05.1.454.light.4.raw

SEQ ID NO: 601613 - DNA, 493 bp, Homo sapiens
  misc_feature: HIJSMM301DS0O9.11.81.H04.1.454.light.4.raw
cgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagttttttactgtcagcagtatagtaactggcctccgtacacttttggccaggggaccaagctagaaatcaaacgaactgtggctgcacatctgtcttcta

SEQ ID NO: 601614 - DNA, 515 bp, Homo sapiens
  misc_feature: HIJSMM301CGHYM.10.38.D05.1.454.light.4.raw
catagtagtgcacgaccggtgctcgatttagtatctgatagttgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctcaggggtttctgatcgcttctttgcctccaagtctggcaacacggcctccctgaccatctctgggctccagactgaggacgaggctgattattactgcagctcacatacaagcggcagcggttgggtggttcggcggggggaccacgactgaccgtcctaggtcagcccaaggctgccccctcggtcactctgtt

SEQ ID NO: 601615 - DNA, 478 bp, Homo sapiens
  misc_feature: HIJSMM301B83XH.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacatactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacacctgcgtggttttggctgttcggcggcggac

SEQ ID NO: 601616 - DNA, 499 bp, Homo sapiens
  misc_feature: HIJSMM301DLZVR.43.69.G03.1.454.light.4.raw
tgtgagtagtcacgaccggtgctcgatttagtcgctgcgtaaaggagaaagggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaaggctgaccgtcctaggtcagcccaaggctgcccctcggtca

SEQ ID NO: 601617 - DNA, 513 bp, Homo sapiens
  misc_feature: HIJSMM301B9FBO.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaatagtactactcctgtggttttcggcggagggaccaaggctgaccgtcctaggtcagcccaaggctgcccctcggtcactctgttccccg

SEQ ID NO: 601618 - DNA, 490 bp, Homo sapiens
  misc_feature: HIJSMM301AM2GS.14.36.D03.1.454.light.4.raw
cgtctagtaccacgaccggtgctcgatttagctgcgtcacgatctctcttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaactcatgatttatgaggtcagtaatcggccctcaggggtttctaatcgcttctctggctccaagtctggcaacacggcctccctgaccatctctgggctccaggctgaggacgagtctgattattattgtcagctcatatgcacctggcagcaatcatgtggtttcggcggggggaccaaggtgaccgtcctaggtcagccc

SEQ ID NO: 601619 - DNA, 485 bp, Homo sapiens; identical to SEQ ID NO: 536263
  misc_feature: HIJSMM301BCPVA.47.78.H01.1.454.light.4.raw

SEQ ID NO: 601620 - DNA, 511 bp, Homo sapiens; identical to SEQ ID NO: 573526
  misc_feature: HIJSMM301A3RFJ.15.34.D01.1.454.light.4.raw

SEQ ID NO: 601621 - DNA, 495 bp, Homo sapiens; identical to SEQ ID NO: 554164
  misc_feature: HIJSMM301CYA3Y.27.78.H01.1.454.light.4.raw

SEQ ID NO: 601622 - DNA, 496 bp, Homo sapiens
  misc_feature: HIJSMM301CX5UV.43.49.E05.1.454.light.4.raw
tgtgagtagtcacgaccggtgctcgatttagagcgactagcaacacacaaagggggaagagctgctcagttaggacccagagggaaccatggaaaccccagcgcagcttctcttcctcctgctactctggctcccagataccaccggagaaattgtgttgacgcagtctccaggcaccgtgtctttgtctccaggggaaagagccaccttctcttgcagggccagtcagagtgttagcagcaactacttagcctggtaccagcagaaacctggccaggctcccaggctcctcatctatggtacatccaacagggccactggcataccagacaggttcagtggcagcgggtctgggacagacttcactctcaccatcagcagactggagcctgaagattttgcagtgtattactgtcagcagtatggtagctcacaggggacgttcggccaagggaccaaggtggaaatcaaacgaactgtggctgcaccatctgtt

SEQ ID NO: 601623 - DNA, 491 bp, Homo sapiens
  misc_feature: HIJSMM301EQG5T.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgttcggccagggaccaaggtggaagtcaaacgaactagtggctgcaccatctgtctt

SEQ ID NO: 601624 - DNA, 508 bp, Homo sapiens
  misc_feature: HIJSMM301DEMWZ.48.23.C01.1.454.light.4.raw
  modified_base (489)..(489): a, c, t, g, unknown or other
  modified_base (506)..(506): a, c, t, g, unknown or other
agtatacatacacgaccggtgctcgatttagtacacgtgattagggattggggagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagatttgcagtgtattactgtcagcagtatggtagctcaccgatcacctcgtccgaacggaacgacgaactggagagtaacgtaaacctagtagcgtcgnaccactactgtcttctntt

SEQ ID NO: 601625 - DNA, 475 bp, Homo sapiens
  misc_feature: HIJSMM301D6KN1.4.14.B03.1.454.light.4.raw
agcactgtagcacgaccggtgctcgatttagtgtgagtagttccgcgggggcaggagtcagactcagtcaggacacagcatggacatgagggtccccgctcagctcctggggctcctgctgctctggctcccaggtgccagatgtgacatccaaatgacccagtctccttccaccctgtctgcatctgtgggagacagagtcactatcacttgccgggccagtcagagcattagtggctggctggcctggtatcagcagaaaccagggagagcccctaagctcttgatctttgatgccaccaatttggaaagtggggtcccatcaagattcagcggcagtggatttgggacagaattcactctcaccatcagcagcctgcagcctggtgattttgcaacttattactgccaacagtataatagttattctctcactttcggcggagggacgaaggtggtagatcaacgaaactgt

SEQ ID NO: 601626 - DNA, 464 bp, Homo sapiens; identical to SEQ ID NO: 537214
  misc_feature: HIJSMM301COCB4.18.59.F04.1.454.light.4.raw

SEQ ID NO: 601627 - DNA, 510 bp, Homo sapiens
  misc_feature: HIJSMM301BIRPX.7.34.D01.1.454.light.4.raw
cgtgtctctacacgaccggtgctcgatttagatcgtctgtgttgggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacagcattatttgggtgttcggcggagggaccaagctgaccgtcctgctcagcccaaggctgccccctcggtcact

SEQ ID NO: 601628 - DNA, 455 bp, Homo sapiens
  misc_feature: HIJSMM301CWRI0.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccaccctcctccacgagagta

SEQ ID NO: 601629 - DNA, 479 bp, Homo sapiens
  misc_feature: HIJSMM301EGZP7.41.57.F02.1.454.light.4.raw
tctatactatcacgaccggtgctcgatttagctcgatatagttgggtttggggctccaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacagctacaatgttggcaacgaaggagcagcttggctgcagcagtaccagggccaccctcccaaattgctatcatacaggaagaacaaccgcccctcggggatctccgagagattctctgcatcaacgtcaggaacatagcctccctgaccattactggactccagcctgaggacgaggctgactattactgctcagcatgggacagcagcctcaatgtttgggtgttcggcggagggaccaagctgaccgtcct

SEQ ID NO: 601630 - DNA, 494 bp, Homo sapiens
  misc_feature: HIJSMM301B27Z4.41.53.E09.1.454.light.4.raw
tctatactatcacgaccggtgctcgatttagagagagtgtgttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggaggaccaagctgaccgtcctaggtcagcccaa

SEQ ID NO: 601631 - DNA, 502 bp, Homo sapiens
  misc_feature: HIJSMM301DO96W.16.73.G07.1.454.light.4.raw
  modified_base (449)..(449): a, c, t, g, unknown or other
  modified_base (492)..(492): a, c, t, g, unknown or other
tgtactactccacgaccggtgctcgatttagctctacgctcaggggcaggcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagtttatactgtcaacatattataataatccatttaatttcggcggagggaccaaggtggaggtanaacgaaacgtacgtggcgtcgcaccactactcgttctcttacncttccctccc

SEQ ID NO: 601632 - DNA, 502 bp, Homo sapiens; identical to SEQ ID NO: 537298
  misc_feature: HIJSMM301BEN67.27.78.H01.1.454.light.4.raw

SEQ ID NO: 601633 - DNA, 485 bp, Homo sapiens; identical to SEQ ID NO: 535501
  misc_feature: HIJSMM301AYP0S.3.10.A10.1.454.light.4.raw

SEQ ID NO: 601634 - DNA, 506 bp, Homo sapiens
  misc_feature: HIJSMM301AKWIP.27.78.H01.1.454.light.4.raw
  modified_base (501)..(501): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggtccgaagggaacgacgacctggaggattaaacgaaactacgtggctgcaccactactntcgtt

SEQ ID NO: 601635 - DNA, 506 bp, Homo sapiens
  misc_feature: HIJSMM301EURTE.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggttattactgtcagcagtataataactggcctccacggtacacttttggtccgaggggaaccgaagctggaggatacaaacgaacgtagttggctggcaccatctgtt

SEQ ID NO: 601636 - DNA, 486 bp, Homo sapiens; identical to SEQ ID NO: 535043
  misc_feature: HIJSMM301AVRG6.46.35.D02.1.454.light.4.raw

SEQ ID NO: 601637 - DNA, 504 bp, Homo sapiens
  misc_feature: HIJSMM301AY171.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcactaatcggccctcaggggtttctaatcgcttctctggctcaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccccta

SEQ ID NO: 601638 - DNA, 444 bp, Homo sapiens; identical to SEQ ID NO: 535192
  misc_feature: HIJSMM301D6O62.5.9.A09.1.454.light.4.raw

SEQ ID NO: 601639 - DNA, 509 bp, Homo sapiens; identical to SEQ ID NO: 543772
  misc_feature: HIJSMM301EE5Q2.2.21.B10.1.454.light.4.raw

SEQ ID NO: 601640 - DNA, 493 bp, Homo sapiens
  misc_feature: HIJSMM301CSCEC.40.11.A11.1.454.light.4.raw
tctagcgactcacgaccggtgctcgatttagctacgactgcaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtcttttatacaactccaacaagcagcactacttagcttggtaccagcagaaaccaggacagcctcctaaactgctcatttactgggcctctacccgggaatccggggtccctgaccgattcagtggcagcgggtctgggacagatttcactctgaccatcagcagcctgcaggctgaagatgtggcagtttattactgtcaacaatattatattattccgaggacgttcggccaagggaccaaggtggaaatcaaacgaactgtggctgcaccatcctgtcttcatcttcccgccat

SEQ ID NO: 601641 - DNA, 489 bp, Homo sapiens; identical to SEQ ID NO: 535139
  misc_feature: HIJSMM301D4V31.14.55.E11.1.454.light.4.raw

SEQ ID NO: 601642 - DNA, 473 bp, Homo sapiens
  misc_feature: HIJSMM301A5NJN.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgtattttgctcctccgagtgcctacttttggcgggggaccaaggtggacatcaaacgaa

SEQ ID NO: 601643 - DNA, 521 bp, Homo sapiens; identical to SEQ ID NO: 539470
  misc_feature: HIJSMM301EPE0W.27.23.C01.1.454.light.4.raw

SEQ ID NO: 601644 - DNA, 494 bp, Homo sapiens
  misc_feature: HIJSMM301AN3ZQ.43.55.E11.1.454.light.4.raw
tgtgagtagtcacgaccggtgctcgatttagcactcgcacgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgaggtcaataagcggccgtcaggggtccctgatcgcttctctggctccaagtctggcaacacggccaccctgaccgtctctgggctccaggctgaggatgaggctcattattactgcagctcatatacaggcaacaagaatttggtgttcggcggagggaccgagctgaccgtcctaggtcagcccaaggctg

SEQ ID NO: 601645 - DNA, 517 bp, Homo sapiens
  misc_feature: HIJSMM301DW1BE.12.85.H08.1.454.light.4.raw
atacgacgtacacgaccggtgctcgatttagtatcactcagtcgcgggggggtcgtcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttggtcgttataactttgtctcctggtacaaacagcacccaggcaaagccccccaactcctgatttatgaggtcactattcggtcctcaggaatttctaatcgcttctctggttccaagtctggcaacacggcctccctgaccatctctggggtccaggctgaggacgaggctgattattactgcagttcatatacaagcacttccactctcgtggtgttcggcggtgggaccaagctgaccgtcctaagtcagcccaaggctcgccccctcggtcactctgttcccc

SEQ ID NO: 601646 - DNA, 505 bp, Homo sapiens
  misc_feature: HIJSMM301AHGEF.18.59.F04.1.454.light.4.raw
tacgagtatgcacgaccggtgctcgatttagtacacacacttagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggactgggaccaaggtcaccgtcctaggtcagcccaaggccaaccccca

SEQ ID NO: 601647 - DNA, 491 bp, Homo sapiens
  misc_feature: HIJSMM301BMRGO.51.29.C07.1.454.light.4.raw
cgatcgtatacacgaccggtgctcgatttagagtgctacgaagggaaaggggagtcccaaccaggacacagcatggacatgagggtccctactcagctcctggggctcctgctgctctggctctcaggtgccagatgtgacatccagatgacccagtctccgtcctccctgtctgcgtctgtaggagacagagtcaccatcacttgccaggcgagtcaggacattagcaacaatttgatctggtatcagcagaaacctggcagagcccctagtctcatgatctatgatgcatctattttggaagacggggtcccatcccggttcagtgggagtggatctgggacaaatttttctttcaccatcaccaacctgcaacctgaggattttgcaacatatttctgtcaacaatatgataatgtccccaccgtcactttcggcggagggaccaaggtggacctcaaacgaactgtggctgcaccatctgtcttcta

SEQ ID NO: 601648 - DNA, 490 bp, Homo sapiens
  misc_feature: HIJSMM301AQDB6.17.25.C03.1.454.light.4.raw
cgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacagttcccctcgcacttttggcctaggggaccaaagttgagatcaaacgaactgtggctgcaccatctgtt

SEQ ID NO: 601649 - DNA, 444 bp, Homo sapiens; identical to SEQ ID NO: 535192
  misc_feature: HIJSMM301DBLXZ.5.9.A09.1.454.light.4.raw

SEQ ID NO: 601650 - DNA, 480 bp, Homo sapiens; identical to SEQ ID NO: 545402
  misc_feature: HIJSMM301C1YPK.11.17.B06.1.454.light.4.raw

SEQ ID NO: 601651 - DNA, 487 bp, Homo sapiens
  misc_feature: HIJSMM301CKH7C.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcagtgggtcaggcgctgatttcacactgagaatcagcagggtggaggctgaagatgtcggggtttattactgcatgcagggtacagtgtggccttcgctcgcattcggcggagggccaaggtggagatcaaacgaa

SEQ ID NO: 601652 - DNA, 503 bp, Homo sapiens
  misc_feature: HIJSMM301BS7IB.40.46.E02.1.454.light.4.raw
tctagcgactcacgaccggtgctcgatttagactcatctacagggaaagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagaagcattgccaaaaaaatatgcttattggtaccaacagaagtcaggccaggcccctgtgctggtcatctatgaggacaacaaacgaccctccgagatccctgagagattctctggctccagctcagggacaatggccaccttggctctcagtggggcccaggtggaggatgaagctgactactactgttactcagtggacagcagtggaaatcatggggtattcgggcggagggaccaagctgaccgtcctaggtcagcccaaggctgccccctcggtcactctcg

SEQ ID NO: 601653 - DNA, 492 bp, Homo sapiens
  misc_feature: HIJSMM301A9YN4.43.29.C07.1.454.light.4.raw
tgtgagtagtcacgaccggtgctcgatttagagtgctacgaagggaaagggggagtcagacccactcaggacacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtggggtcccatcaagattcagcggtagtggatctgggacagaattcactctcaccgtcagcagcctgcagcctgaagattttgcaacttattactgtctacaagattcttcttacccttcggacgttcggtcaggggaccgaagttgaacatcaatcgaactgtggctgcaccatctgtctt

SEQ ID NO: 601654 - DNA, 478 bp, Homo sapiens; identical to SEQ ID NO: 535129
  misc_feature: HIJSMM301BRRBP.11.11.A11.1.454.light.4.raw

SEQ ID NO: 601655 - DNA, 477 bp, Homo sapiens
  misc_feature: HIJSMM301ETJ6O.52.27.C05.1.454.light.4.raw
cgcagtacgacacgaccggtgctcgatttagacgcgatcgaagggtttggggctgggcctcaggaagcagcatcggaggtgcctcagccatggcatggatccctctcttcctcggcgtccttgcttactgcacaggatccgtggcctcctatgagctgactcagccacactcagtgtccgtgtccccaggacagacagccagcatcacctgctctggagatgaattggggaataaatttgcttgctggtatcaccagaagccaggccagtcccctgtcctggtcatctatcaagatgtcaagcggccctcagggatccctgagcgattctctggctccaactctgggaacacagccactctgaccatcagcgggacccaggctatggatgaggctgactattactgtcaggcgtgggacagcaacactgtggtattcggcggagggaccaagctgaccgtcctaggtcagcccaagg

SEQ ID NO: 601656 - DNA, 494 bp, Homo sapiens; identical to SEQ ID NO: 537003
  misc_feature: HIJSMM301ESUDT.10.79.H02.1.454.light.4.raw

SEQ ID NO: 601657 - DNA, 490 bp, Homo sapiens
  misc_feature: HIJSMM301DX8T4.48.37.D04.1.454.light.4.raw
agtatacatacacgaccggtgctcgatttagtagcatactgttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggaggaccaagctgacagtcctaggtcagcccaaggctgcccccc

SEQ ID NO: 601658 - DNA, 487 bp, Homo sapiens
  misc_feature: HIJSMM301ELYWN.48.22.B11.1.454.light.4.raw
agtatacatacacgaccggtgctcgatttagacgacagctcagggggagtcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttatttagcctggtttcagcagaaaccagggaaagcccctaaactcctgatctacgctgcatccactttgcacagtggggtcccgtctaggttcagcggcagcggatctgggacagatttcactctcaccatcagcagcctgcagcctgaagatgttgcaacttattactgtcaacagcttagtacgtaaccctccgtacacttttggccaggggaccaaggtggagatacaaacgaactgtggctgcaccatctgtt

SEQ ID NO: 601659 - DNA, 491 bp, Homo sapiens; identical to SEQ ID NO: 535294
  misc_feature: HIJSMM301EKQEL.16.68.G02.1.454.light.4.raw

SEQ ID NO: 601660 - DNA, 499 bp, Homo sapiens
  misc_feature: HIJSMM301C46UG.19.71.G05.1.454.light.4.raw
tactctcgtgcacgaccggtgctcgatttagtgtcgtcgcaagagagaggggggaggtacaacaggcaggcaggggcagcaagatggtgttacagacccaggtcttcatttctctgttgctctggatctctggtgcccacggggacatcgtgatgacccagtctccagactccctggctgtgtctctgggcgagcgggccaccatcaactacaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttatattgtcaacaatattattatacttcgtggacgttcggccaagggaccaaggtggatatcagacgaactgtggctgcacca

SEQ ID NO: 601661 - DNA, 516 bp, Homo sapiens
  misc_feature: HIJSMM301DUZTT.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcggtcagggaccaacggtaggaaggtcgaaacgaaacctagtaggcgtgcaccaactctgtcttctatcttccgtcccact

SEQ ID NO: 601662 - DNA, 507 bp, Homo sapiens
  misc_feature: HIJSMM301EZOWM.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggtcagtgggtctgggacttcgttcactctcaccatcaataacctgcaatctgacgactttgcagtttatttctgtcagcagtctgaagactggccgttcacttttcggcggagggaccaaggtggacctcaaacgaactgtggctgcaccatctgtcttcatcttcccgcc

SEQ ID NO: 601663 - DNA, 496 bp, Homo sapiens; identical to SEQ ID NO: 535541
  misc_feature: HIJSMM301CQFB4.3.33.C11.1.454.light.4.raw

SEQ ID NO: 601664 - DNA, 496 bp, Homo sapiens; identical to SEQ ID NO: 536248
  misc_feature: HIJSMM301BKGKG.22.27.C05.1.454.light.4.raw

SEQ ID NO: 601665 - DNA, 480 bp, Homo sapiens; identical to SEQ ID NO: 535291
  misc_feature: HIJSMM301ECO42.22.59.F04.1.454.light.4.raw

SEQ ID NO: 601666 - DNA, 486 bp, Homo sapiens; identical to SEQ ID NO: 535385
  misc_feature: HIJSMM301D7FDI.19.71.G05.1.454.light.4.raw

SEQ ID NO: 601667 - DNA, 511 bp, Homo sapiens
  misc_feature: HIJSMM301DUXC7.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaactagttttctcggggcgttcggtccaagggaccgaaggtaggaaagtacaaacgaactagtggctgcaccactctgtcttcatcttccccg

SEQ ID NO: 601668 - DNA, 508 bp, Homo sapiens; identical to SEQ ID NO: 535649
  misc_feature: HIJSMM301B0QP4.47.55.E11.1.454.light.4.raw

SEQ ID NO: 601669 - DNA, 511 bp, Homo sapiens
  misc_feature: HIJSMM301EWVK1.12.55.E11.1.454.light.4.raw
atacgacgtacacgaccggtgctcgatttagcactcgcacgttgggtttgggggtggtagctcaggaagcagagcctggagcatctccactatggcctgggctccactacttctcaccctcctcgctcactgcacaggttcttgggccagctttttgctgactcagccccactctgtgtcggggtctccggggaagacggtaaccatctcctgcaccggcagcagtggcaacattgccacgaagtatgtgcagtggtaccagcagcgcccgggcagtgcccccaccactataatctatgaggatgaccgacgaccctctggggtccctgatcgtttctctggctccatcgacagctcctccaattctgcctccctcaccatctctggactcatgtctgaggacgaggctgactactactgtcagtcttatgataatacgtcttgttttttcggtcggtcgggaccgaagctgaccgtcctaggtcagcccaaggctcgccccctcggtcta

SEQ ID NO: 601670 - DNA, 494 bp, Homo sapiens
  misc_feature: HIJSMM301BG6DG.22.86.H09.1.454.light.4.raw
acatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggctgccccctcggtcactctgttcccgcctcctcacgtcg

SEQ ID NO: 601671 - DNA, 520 bp, Homo sapiens
  misc_feature: HIJSMM301BHA4E.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgacctcctaggtcagcccaaggctgccccctcggtcactctgttcccgccct

SEQ ID NO: 601672 - DNA, 493 bp, Homo sapiens; identical to SEQ ID NO: 535278
  misc_feature: HIJSMM301AEPQ2.51.81.H04.1.454.light.4.raw

SEQ ID NO: 601673 - DNA, 498 bp, Homo sapiens; identical to SEQ ID NO: 535469
  misc_feature: HIJSMM301A94ZS.12.18.B07.1.454.light.4.raw

SEQ ID NO: 601674 - DNA, 501 bp, Homo sapiens
  misc_feature: HIJSMM301CFAJ3.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcgagggaccaagctgaccgtcctgggtcagcccaaggctgccccctcggtca

SEQ ID NO: 601675 - DNA, 473 bp, Homo sapiens
  misc_feature: HIJSMM301BSOYX.52.40.D07.1.454.light.4.raw
cgcagtacgacacgaccggtgctcgatttagtgatagagcgtaacaacagaggggagtcccagtcaggacacagcatggacatgagggtccccgctcagctcctggggctcctgctgctctggctcccaggtgccagatgtgacatccagttgacccagtctccatccttcctatctgcatctgtaggagacagagtcaccatcacttgtcgggcgagtcagggtattagcagctggttagcctggtatcagcagaaaccagggaaagcccctaagctcctgatctatgctgcatccactttgcagagtggggtcccatcaaggttcagcgcagtggatctgggagacaattcactctcacaatcagcagcctgcagcctgaagattttgcgacttattactgtcaacacttaatcgttaccctcttttcggccctgggaccaaagtggatatcaacgaactgtggctgcacc

SEQ ID NO: 601676 - DNA, 489 bp, Homo sapiens; identical to SEQ ID NO: 535091
  misc_feature: HIJSMM301A7QPH.47.36.D03.1.454.light.4.raw

SEQ ID NO: 601677 - DNA, 482 bp, Homo sapiens
  misc_feature: HIJSMM301BCDAQ.49.28.C06.1.454.light.4.raw
agtcgagagacacgaccggtgctcgatttagagctcacgtattgggtttggggacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccgagggtggagatcaaacgaa

SEQ ID NO: 601678 - DNA, 454 bp, Homo sapiens; identical to SEQ ID NO: 535005
  misc_feature: HIJSMM301CDD09.19.86.H09.1.454.light.4.raw

SEQ ID NO: 601679 - DNA, 494 bp, Homo sapiens; identical to SEQ ID NO: 539065
  misc_feature: HIJSMM301EJSNX.11.81.H04.1.454.light.4.raw

SEQ ID NO: 601680 - DNA, 510 bp, Homo sapiens
  misc_feature: HIJSMM301AVA0B.17.33.C11.1.454.light.4.raw
  modified_base (468)..(468): a, c, t, g, unknown or other
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgacccgtnttaagtcagcccaaggctgccccctcggtcactctgttcccg

SEQ ID NO: 601681 - DNA, 495 bp, Homo sapiens; identical to SEQ ID NO: 543631
  misc_feature: HIJSMM301BJQ77.11.59.F04.1.454.light.4.raw

SEQ ID NO: 601682 - DNA, 517 bp, Homo sapiens
  misc_feature: HIJSMM301EPBKR.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattatctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaacccactgtcactctgttcccacctcctccgtgt

SEQ ID NO: 601683 - DNA, 517 bp, Homo sapiens
  misc_feature: HIJSMM301E2UT4.17.37.D04.1.454.light.4.raw
cgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctgtgggggaaacaatgttggaagtaaaactgtgcactggtaccagcagaagccaggccaggcccctgtgctggtcgtctatgatgataccgaccggccctcagggatccctgagcgattctctggctccaactctgggaacacggccaccctgaccatcggcagggtcgaaggccggggatgaggccgactattattgtcaggtgtgggatagtagtagtgatcatgtggtattcgggcggagggaccaagctgaccgtccttggtcagcccaaggctgccccctcggtcactctcgttcccgccct

SEQ ID NO: 601684 - DNA, 494 bp, Homo sapiens; identical to SEQ ID NO: 539894
  misc_feature: HIJSMM301EBSQU.16.53.E09.1.454.light.4.raw

SEQ ID NO: 601685 - DNA, 508 bp, Homo sapiens; identical to SEQ ID NO: 537871
  misc_feature: HIJSMM301COJ2F.8.33.C11.1.454.light.4.raw

SEQ ID NO: 601686 - DNA, 486 bp, Homo sapiens
  misc_feature: HIJSMM301BZ7KW.3.33.C11.1.454.light.4.raw
agacgcactccacgaccggtgctcgatttagagtgagctcgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgcaatttattactgtcagcagtataataactggtggacgttcggccaagggaccaaggtagaaatacaaacgaactgtggctgcaccatct

SEQ ID NO: 601687 - DNA, 521 bp, Homo sapiens
  misc_feature: HIJSMM301CDH7A.41.16.B05.1.454.light.4.raw
tctatactatcacgaccggtgctcgatttagagctcacgtaagggggaactgctcagttaggacccagacggaaccatggaagccccagcgcagcttctcttcctcctgctactctggctcccagataccactggagacatagtgatgacgcagtctccagccaccctgtctgtgtctccaggggagacagccaccctctcctgcagggccagtcagagtgttagtaacaacttagcatggtaccagcagaaacctggccaggctcccaggctcctcatctatcgtgcgtccaccagggcaactggtatcccagccaggttcagtggcgttgggtctgggacagagttcactctcaccatcaccagcctgcagtctgaagattttgctagtttattactgtcaccaatataataactggtacacttttggccaggggaccaaggtcgtacgagtactaacgaaacgtacgtggtcgtcgtcaccaactcttcgttcgttctactcttcccgttcccgctta

SEQ ID NO: 601688 - DNA, 444 bp, Homo sapiens; identical to SEQ ID NO: 535027
  misc_feature: HIJSMM301D5076.8.73.G07.1.454.light.4.raw

SEQ ID NO: 601689 - DNA, 447 bp, Homo sapiens
  misc_feature: HIJSMM301DKRJ2.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaaccctctgtcactctgttcccaccctcctccatactcgta

SEQ ID NO: 601690 - DNA, 493 bp, Homo sapiens; identical to SEQ ID NO: 540127
  misc_feature: HIJSMM301ADXH2.10.17.B06.1.454.light.4.raw

SEQ ID NO: 601691 - DNA, 496 bp, Homo sapiens; identical to SEQ ID NO: 535843
  misc_feature: HIJSMM301B74UQ.3.71.G05.1.454.light.4.raw

SEQ ID NO: 601692 - DNA, 486 bp, Homo sapiens
  misc_feature: HIJSMM301DGO0N.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaggctggagatcaaacgaactgtggctgcaccat

SEQ ID NO: 601693 - DNA, 482 bp, Homo sapiens; identical to SEQ ID NO: 536979
  misc_feature: HIJSMM301BZMY6.16.81.H04.1.454.light.4.raw

SEQ ID NO: 601694 - DNA, 485 bp, Homo sapiens; identical to SEQ ID NO: 536630
  misc_feature: HIJSMM301AGD54.13.56.F01.1.454.light.4.raw

SEQ ID NO: 601695 - DNA, 503 bp, Homo sapiens
  misc_feature: HIJSMM301DYN9C.41.71.G05.1.454.light.4.raw
tctatactatcacgaccggtgctcgatttagtgtcgtcgcaagagagaggggggagtcagacccacgtcaggacacagcatggacatgagggtccccgcctcagctcctggggctcctgctgctctggctcccaggtgccaaatgtgacatccagatgacccagtctccttccaccctgtctgcatctgtaggagacagagtcaccatcacttgccgggccagtcaggttattaataattggttggcctggtatcagcagaaaccagggaaagcccctaaactcctgatctataaggcgtctactttagagagtggggtcccttcaaggttcagtggcagtggatctgggacagagttcaccctcaccatcggcagcctgcagcctgaagatatcgcaacttattactgtcaacaatataacacttattcaggggcattcggccaagggaccaaggtggaaattaaacgaactgtggctgcaccatctgtcttcatcttcccg

SEQ ID NO: 601696 - DNA, 509 bp, Homo sapiens; identical to SEQ ID NO: 541829
  misc_feature: HIJSMM301BA77F.17.28.C06.1.454.light.4.raw

SEQ ID NO: 601697 - DNA, 471 bp, Homo sapiens; identical to SEQ ID NO: 550268
  misc_feature: HIJSMM301BSK5Y.15.8.A08.1.454.light.4.raw

SEQ ID NO: 601698 - DNA, 501 bp, Homo sapiens
  misc_feature: HIJSMM301CK5QG.5.86.H09.1.454.light.4.raw
  modified_base (493)..(493): a, c, t, g, unknown or other
atcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaaggcngccccctc

SEQ ID NO: 601699 - DNA, 499 bp, Homo sapiens
  misc_feature: HIJSMM301BY4QB.52.79.H02.1.454.light.4.raw
cgcagtacgacacgaccggtgctcgatttagtgtcacacgaagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactctcg

SEQ ID NO: 601700 - DNA, 504 bp, Homo sapiens
  misc_feature: HIJSMM301DBGAD.51.23.C01.1.454.light.4.raw
cgatcgtatacacgaccggtgctcgatttagtacacgtgattagggattgggggaggaactgctcagttaggacccagagggaaccatggaagccccagctcagcttctcttcctcctgctactctggctcccagataccatcggggaaactgtgttgacacagtctccagccaccctgtctttgtctccaggggaaagagccaccctctcctgcagggccagtgagagtattgacatcttcttggcctggtaccaacagaaacctggccaggctccccgactcctcatttatgatgcatccaaaagggtcgttggcatcccagccaggttcagtggcagtgggtctgggacagaattcactctcaccatcaccagactagagcctgaagattttgcagtttattactgtcagcagcgtaacaactggctctctttcggcggagggaccaaggtggagatcaaacgaaactgtggctgcaccatctgtcttcatctcccgccat

SEQ ID NO: 601701 - DNA, 463 bp, Homo sapiens; identical to SEQ ID NO: 535062
  misc_feature: HIJSMM301DNNLF.11.73.G07.1.454.light.4.raw

SEQ ID NO: 601702 - DNA, 508 bp, Homo sapiens
  misc_feature: HIJSMM301AWXTR.8.42.D09.1.454.light.4.raw
ctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtctaggtcagcccaaggctgccccctcggtcactctcgttcccaccct

SEQ ID NO: 601703 - DNA, 507 bp, Homo sapiens
  misc_feature: HIJSMM301CRO7X.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccaccctgaccatcagcgcggtcgaagccggagatgaggccgactattactgtcaggtgtgggacagtaatagtgatcccgagcaggttttcggcggtggaccaagctgaccgtcctaagtcagccaaggctgccccctcggtcactctgtt

SEQ ID NO: 601704 - DNA, 497 bp, Homo sapiens
  misc_feature: HIJSMM301CAJ45.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcacacgtgggacatgggcactgcgatcttcggcggagggaccaagctgaccgtcctgggtcagcccaaggctgccccctcggtcactccg

SEQ ID NO: 601705 - DNA, 493 bp, Homo sapiens
  misc_feature: HIJSMM301BDKVW.40.43.D10.1.454.light.4.raw
tctagcgactcacgaccggtgctcgatttagactagcagtaaggggactgctcagttaggacccagagggaaccatggaagccccagctcagcttctcttcctcctgctactctggctcccagaaaacaccggagaaattctgttgacacagtctccaggcaccctgtctttgtctccaggggaaagagccaccctctcctgcagggccagtcagagtgtcggcaccttcttagcctggtaccaacagaagcctggccaggctcccaggctcctcatttatgaagcgtcgaacagggccactggcatcccagccaggttcagtgccagtgggtctgggacagacttcactctcaccatcagcagcctagagcctgaagattttgcactttattactgtcaccagcgtagcagctggcctcgaacgttgccaaggaccaaggtggacgatcaagcgaactgtggctgcaccatctgtcttcatcttcccgccat

SEQ ID NO: 601706 - DNA, 506 bp, Homo sapiens; identical to SEQ ID NO: 561023
  misc_feature: HIJSMM301AI0EA.11.57.F02.1.454.light.4.raw

SEQ ID NO: 601707 - DNA, 496 bp, Homo sapiens
  misc_feature: HIJSMM301B35T6.51.83.H06.1.454.light.4.raw
cgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagtttattattgtcagcagcgaaacaactggcctccttggacgttcggaccaagggaccaaggtggaaatcaaacgaactgtggctgcaccatctgtcttcat

SEQ ID NO: 601708 - DNA, 489 bp, Homo sapiens; identical to SEQ ID NO: 558034
  misc_feature: HIJSMM301CMP3Q.8.12.B01.1.454.light.4.raw

SEQ ID NO: 601709 - DNA, 504 bp, Homo sapiens
  misc_feature: HIJSMM301B8MAI.14.86.H09.1.454.light.4.raw
  modified_base (495)..(495): a, c, t, g, unknown or other
cgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaagagccaccctctcctgcagggccagtcagagtgttagcacctccttagcctggtaccaacagaaacctggccaggctcccagcctcctcatctctgatgcttccaacagggccactggcatcccagccaggttcagtggcagtgggtctgggacagacttcactctcaccatcagctccctagagcctggagattttgtagtttattactgtcagcagtatagcagctggcctcccactttcggcggagggaccaaggtggagatccaacgaactgtggctgcaccatctgtctctntcttccccg

SEQ ID NO: 601710 - DNA, 445 bp, Homo sapiens; identical to SEQ ID NO: 575347
  misc_feature: HIJSMM301EGOA0.9.9.A09.1.454.light.4.raw

SEQ ID NO: 601711 - DNA, 503 bp, Homo sapiens
  misc_feature: HIJSMM301CTMHO.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaaacg

SEQ ID NO: 601712 - DNA, 491 bp, Homo sapiens; identical to SEQ ID NO: 545038
  misc_feature: HIJSMM301ED0QV.22.25.C03.1.454.light.4.raw

SEQ ID NO: 601713 - DNA, 487 bp, Homo sapiens; identical to SEQ ID NO: 536536
  misc_feature: HIJSMM301BYTVH.26.45.E01.1.454.light.4.raw

SEQ ID NO: 601714 - DNA, 506 bp, Homo sapiens
  misc_feature: HIJSMM301ASVTH.43.57.F02.1.454.light.4.raw
  modified_base (434)..(434): a, c, t, g, unknown or other
  modified_base (454)..(454): a, c, t, g, unknown or other
tgtgagtagtcacgaccggtgctcgatttagctcgatatagttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtcccctggacagtcagtcaccatctcctgcactggaagcagcagtgacattggtggttatacatatgtctcctggtaccaacagcacccaggcaaagcccccaaactcatgatttatgaggtcaataagcggccgtcaggggtccctgatcgcttctctggctccaagtctggcaacacggccaccctgaccgtctctgggctccaggctgaggatgaggctcgattattactgcaagtctctatanaccagctaacagaatttggngttcgggacgaagggaccagcctcgacgtctaggtccaaggcccaaggccct

SEQ ID NO: 601715 - DNA, 495 bp, Homo sapiens
  misc_feature: HIJSMM301DOG9N.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagccccaaactcatgatttatgaggtcagtaatcggccctcaggggtttctaatcgcttctctggctccaagtctggcaacacggcctccctgaccatctctgggctccaggctgaggacgagggtgattattactgcagctcatataggaagtggcagcactctcgtattcggcggtggggaccaagctgaccgtcctaggtcagcccaagg

SEQ ID NO: 601716 - DNA, 520 bp, Homo sapiens; identical to SEQ ID NO: 543998
  misc_feature: HIJSMM301DN9UE.27.23.C01.1.454.light.4.raw

SEQ ID NO: 601717 - DNA, 492 bp, Homo sapiens; identical to SEQ ID NO: 535426
  misc_feature: HIJSMM301BSJ66.47.78.H01.1.454.light.4.raw

SEQ ID NO: 601718 - DNA, 505 bp, Homo sapiens
  misc_feature: HIJSMM301BHYAB.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtggaaatcaaacgaactagtggcgtgcaccatctgtcttcatcttccccg

SEQ ID NO: 601719 - DNA, 492 bp, Homo sapiens
  misc_feature: HIJSMM301ECHHO.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattgggttctaatcgggcctccggggtccctaacaggttcagtggcagtggatcaggcacagattttacactgaaaatcagcagagtggaggctgaggatgttggggtttattactgcatgcaagctctacaacctctgcggactttcggccctgggaccaaagtggagatcaacgaactgtggctgcaccatctgtctt

SEQ ID NO: 601720 - DNA, 507 bp, Homo sapiens
  misc_feature: HIJSMM301B4J87.21.22.B11.1.454.light.4.raw
  modified_base (432)..(432): a, c, t, g, unknown or other
tcgtcgctcgcacgaccggtgctcgatttagacgacagctcagggtggggtcaaaaacccggggaggggggtctgatttgcatggatggactctccccctctcagagtacgaagagagggagagatctgggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattcnctggctccaagtctggcacctcagccctcctgaccatcagtgggctccggtccgaggatgaggctgactattact

SEQ ID NO: 601721 - DNA, 491 bp, Homo sapiens; identical to SEQ ID NO: 536211
  misc_feature: HIJSMM301CF88V.16.53.E09.1.454.light.4.raw

SEQ ID NO: 601722 - DNA, 479 bp, Homo sapiens; identical to SEQ ID NO: 573236
  misc_feature: HIJSMM301EK8C4.11.11.A11.1.454.light.4.raw

SEQ ID NO: 601723 - DNA, 521 bp, Homo sapiens; identical to SEQ ID NO: 538715
  misc_feature: HIJSMM301ES0BH.27.23.C01.1.454.light.4.raw

SEQ ID NO: 601724 - DNA, 501 bp, Homo sapiens; identical to SEQ ID NO: 536142
  misc_feature: HIJSMM301DLAEN.15.1.A01.1.454.light.4.raw

SEQ ID NO: 601725 - DNA, 506 bp, Homo sapiens
  misc_feature: HIJSMM301DIHDB.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggccgtccgggggccacttccggccctgggaccaaagtggatatcaaacgaactgtggctgcaccatctgtctt

SEQ ID NO: 601726 - DNA, 498 bp, Homo sapiens; identical to SEQ ID NO: 547944
  misc_feature: HIJSMM301CZGDT.41.53.E09.1.454.light.4.raw

SEQ ID NO: 601727 - DNA, 509 bp, Homo sapiens; identical to SEQ ID NO: 543772
  misc_feature: HIJSMM301ER31M.2.21.B10.1.454.light.4.raw

SEQ ID NO: 601728 - DNA, 484 bp, Homo sapiens
  misc_feature: HIJSMM301C27DL.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcccaccctcctcgctacgaga

SEQ ID NO: 601729 - DNA, 518 bp, Homo sapiens
  misc_feature: HIJSMM301DZOB5.48.17.B06.1.454.light.4.raw
agtatacatacacgaccggtgctcgatttagtcgatagtgaaggggggggtcacaagaggcagcgctctcgggacgtctccaccatggcctgggctctgctgctcctcaccctcctcactcaggacacagggtcctgggcccaggctgccctgactcagccagcctccgtgtctgcctctcctggacagtcggtcaatctttcctgcactggaaccgcctatgacattggaaaatataaccttgtctcctggtaccagcaacacccaggcaaagcccccaaattaattatttatacggtcaataagagaccgtcaggggtctctgctcgcttctctgggtccaagtctggcgacacggcctccctcacaatctctgggctccaggctgacgacgaggcttcctattgctgctcctcatatgtaggatccggctcttatcttgattttcggcggagggaccaagctgaccgtcctacgtcagcccaaggctgccccctcggtcactctgttcccaccct

SEQ ID NO: 601730 - DNA, 478 bp, Homo sapiens
  misc_feature: HIJSMM301CSQU6.5.15.B04.1.454.light.4.raw
atcagacacgcacgaccggtgctcgatttagacagtatatatccgcggggggagtcagactcagtcaggacacagcatggacatgagggtccccgctcagctcctggggctcctgctgctctggctcccaggtgccaaatgtgacatccagatgacccagtctccttccaccctgtctgcatctataggagacagagtcaccatcacttgccgggccagtcagagtattagtaactggttggcctggtatcagcagaaaccaggcaaagccccaaagctccttatctctgatgcctccactttgcacggtggggtcccaccaacgttcagcggcagtggatctgggacagaattcactctcaccatcagcagcctgcagcctgatgatgctgcaacttattactgtcaacaatataacagttattggacgttcggccaaggaccaaggtggaatacaaacgaactgtggctgcaccta

SEQ ID NO: 601731 - DNA, 497 bp, Homo sapiens
  misc_feature: HIJSMM301DWFJS.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgaacaatctgagcggttgggtgttcggcggagggaaccaaactgaccgtcctaggtc

SEQ ID NO: 601732 - DNA, 507 bp, Homo sapiens
  misc_feature: HIJSMM301B3CL8.48.36.D03.1.454.light.4.raw
agtatacatacacgaccggtgctcgatttagctgcgtcacgatctctcttggggggggtctcaggaggcagcactctcgggacgtctccaccatggcctgggctctgctcctcctcagccctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttctattttctaagttcctttttgtcttcggtaactgggaccgaggtcaccgtcctaggtcagcccaaggccaacccactgtcta

SEQ ID NO: 601733 - DNA, 476 bp, Homo sapiens
  misc_feature: HIJSMM301C0VQW.13.4.A04.1.454.light.4.raw
tcacgtactacacgaccggtgctcgatttagagtagtgatcagggggagtcagtcccaaccaggacacagcatggacatgagggtccctgctcagctcctggggctcctgctgctctggctctcaggtgccagatgttacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatcgcatccaatttggaaacaggggtcccatcaaggttcagtggaagtggatctgggacagattttactttcaccatcagcagcctgcagcctgaagatattgcaacatattactgtcagcagtatgataatctcccgatcaccttcggccaagggacacgactggagattaaacgaactgtggctgcacc

SEQ ID NO: 601734 - DNA, 497 bp, Homo sapiens; identical to SEQ ID NO: 536371
  misc_feature: HIJSMM301DMRMN.16.78.H01.1.454.light.4.raw

SEQ ID NO: 601735 - DNA, 500 bp, Homo sapiens
  misc_feature: HIJSMM301DQG8E.22.15.B04.1.454.light.4.raw
acatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaggatgaggctgattattactgcagctcatatggaggcagcgacaatttggtgttcggcggagggaccaagctgaccgtctaggtcagccaaggctgccccctggtcta

SEQ ID NO: 601736 - DNA, 503 bp, Homo sapiens; identical to SEQ ID NO: 536834
  misc_feature: HIJSMM301AMC5N.2.35.D02.1.454.light.4.raw

SEQ ID NO: 601737 - DNA, 488 bp, Homo sapiens; identical to SEQ ID NO: 537124
  misc_feature: HIJSMM301AKHTG.11.25.C03.1.454.light.4.raw

SEQ ID NO: 601738 - DNA, 494 bp, Homo sapiens
  misc_feature: HIJSMM301C6TYQ.52.10.A10.1.454.light.4.raw
cgcagtacgacacgaccggtgctcgatttagcgtcgatctcagggggaggaactgctcagttaggacccagaaggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaacaaaaacctgcccaggctcccaggctcctcatctatgatgcatccaatcgggccactggcatcccagccaggttcagtggcagtgggtctgggacagacttcactctcaccatcagcaacctagagcctgaagactttgcagtttattactgtcagcagcgtagtaagtggcgcttcggccaagggacacgactggaggttaaacgaactgtggctgcaccatctgtcttcatcttcccgccat

SEQ ID NO: 601739 - DNA, 486 bp, Homo sapiens; identical to SEQ ID NO: 575558
  misc_feature: HIJSMM301EJC6Y.10.1.A01.1.454.light.4.raw

SEQ ID NO: 601740 - DNA, 517 bp, Homo sapiens
  misc_feature: HIJSMM301AZ8KG.43.71.G05.1.454.light.4.raw
  modified_base (495)..(495): a, c, t, g, unknown or other
tgtgagtagtcacgaccggtgctcgatttagtgtcgtcgcaagagagaggggggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtctttccatccttttcccccncccaattccttggaaaccttaa

SEQ ID NO: 601741 - DNA, 526 bp, Homo sapiens
  misc_feature: HIJSMM301B96AU.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgtcctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgtttcggcggagggaccgaggctgaccgtccgtaggtcagcccaaggctcgcccccgtcggtcactctcgtcccgccct

SEQ ID NO: 601742 - DNA, 494 bp, Homo sapiens; identical to SEQ ID NO: 535680
  misc_feature: HIJSMM301BKCZ0.16.78.H01.1.454.light.4.raw

SEQ ID NO: 601743 - DNA, 490 bp, Homo sapiens; identical to SEQ ID NO: 535234
  misc_feature: HIJSMM301EZJU6.17.21.B10.1.454.light.4.raw

SEQ ID NO: 601744 - DNA, 442 bp, Homo sapiens
  misc_feature: HIJSMM301D3A3T.41.9.A09.1.454.light.4.raw
tctatactatcacgaccggtgctcgatttagcgagacgcgcagggtcctgggcccagtctgtcctgactcagccaccctcagcgtctgggacccccgggcagacggtgaccatctcctgttctggaagcagttccaacatcggaagtaataatgtgaattggtaccggcaactcccaggaacggcccccaaactcctcatacatagtaatgatcatcggccccctggggtccctgaccgaatctctggctccaggtctggcgcctcagcctccctggtcattagtgggctccagtctgacgatgaggctgactattactgttcagcgtgggatgccagcccgaatcattgggtgttcggcggagggaccaaactgaccgtcctaggtcagcccaaggctgccccctcggtcactctcgttcccaccctcctcatagtataga

SEQ ID NO: 601745 - DNA, 499 bp, Homo sapiens
  misc_feature: HIJSMM301BI6RE.51.83.H06.1.454.light.4.raw
cgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagtttattattgtcagcagcgaaacaactggcctccttggacgttcggccaagggaccaaggtggaaatcaaacgaactgtggctgcaccatctgtcttcattccc

SEQ ID NO: 601746 - DNA, 447 bp, Homo sapiens
  misc_feature: HIJSMM301D5K6V.48.53.E09.1.454.light.4.raw
agtatacatacacgaccggtgctcgatttagagagagtgtgttgggtttggggggacgtcgtgatgacccagtctccagactccctggcagtgtctctgggcgggagggccaccatcaactgcaagtccagccagagtattttatacagctcctacaataagagcgacttagcttggtaccagcagaaaccaggacagcctcctaagttgctcatttactgggcatctaaccggcaatccggggtccctgaccgattcagtggcagcgggtctgggacacatttcgctttcaccatcagcagcctgcaggctgaggatgtggcagtttattactgtcagcaatattatactactccgtggactttcggccaagggaccaaggtggaaatcagacgaactgtggctgcaccatctgtcttcatcttcccgccatctgatatgtatact

SEQ ID NO: 601747 - DNA, 487 bp, Homo sapiens; identical to SEQ ID NO: 554782
  misc_feature: HIJSMM301CHCQX.46.35.D02.1.454.light.4.raw

SEQ ID NO: 601748 - DNA, 486 bp, Homo sapiens; identical to SEQ ID NO: 535043
  misc_feature: HIJSMM301BMWRZ.46.35.D02.1.454.light.4.raw

SEQ ID NO: 601749 - DNA, 484 bp, Homo sapiens
  misc_feature: HIJSMM301DA0N2.17.34.D01.1.454.light.4.raw
cgtagactagcacgaccggtgctcgatttagatcgtctgtgttgggtttgggtcatcacaatatctgcactggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccaagggaccaaggtggaactcaaacgaactgtggctgcaccatctgtcttcatcttcctgccatctgactagtctacg

SEQ ID NO: 601750 - DNA, 514 bp, Homo sapiens; identical to SEQ ID NO: 572493
  misc_feature: HIJSMM301A6CAJ.16.66.F11.1.454.light.4.raw

SEQ ID NO: 601751 - DNA, 484 bp, Homo sapiens; identical to SEQ ID NO: 535400
  misc_feature: HIJSMM301ASYTO.46.26.C04.1.454.light.4.raw

SEQ ID NO: 601752 - DNA, 477 bp, Homo sapiens; identical to SEQ ID NO: 535506
  misc_feature: HIJSMM301CQSRS.7.67.G01.1.454.light.4.raw

SEQ ID NO: 601753 - DNA, 502 bp, Homo sapiens
  misc_feature: HIJSMM301BCFH2.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactggggctcaggcggaagatgaggctgactattactgtaactcccgggacagcagtgctgaccaggtggtattcggcggagggacccacctgaccgtcttaggtcagcccaaggctcgccccctcggtca

SEQ ID NO: 601754 - DNA, 505 bp, Homo sapiens
  misc_feature: HIJSMM301EDOI0.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctaggtcagccccaaggctgccccccg

SEQ ID NO: 601755 - DNA, 499 bp, Homo sapiens; identical to SEQ ID NO: 560527
  misc_feature: HIJSMM301BQFZ4.18.11.A11.1.454.light.4.raw

SEQ ID NO: 601756 - DNA, 497 bp, Homo sapiens; identical to SEQ ID NO: 536376
  misc_feature: HIJSMM301CDWRD.22.9.A09.1.454.light.4.raw

SEQ ID NO: 601757 - DNA, 504 bp, Homo sapiens; identical to SEQ ID NO: 571562
  misc_feature: HIJSMM301C7G00.7.71.G05.1.454.light.4.raw
  modified_base (206)..(206): a, c, t, g, unknown or other

SEQ ID NO: 601758 - DNA, 494 bp, Homo sapiens; identical to SEQ ID NO: 536974
  misc_feature: HIJSMM301BSPJP.16.86.H09.1.454.light.4.raw

SEQ ID NO: 601759 - DNA, 486 bp, Homo sapiens; identical to SEQ ID NO: 535043
  misc_feature: HIJSMM301DUMRM.46.35.D02.1.454.light.4.raw

SEQ ID NO: 601760 - DNA, 487 bp, Homo sapiens
  misc_feature: HIJSMM301DMX0I.13.46.E02.1.454.light.4.raw
tcacgtactacacgaccggtgctcgatttagactcatctacagggaaagggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatgcaagcaacacactggccgtacacttttggccaggggaccaagctggagatcaatcgaa

SEQ ID NO: 601761 - DNA, 498 bp, Homo sapiens
  misc_feature: HIJSMM301C66YN.11.59.F04.1.454.light.4.raw
cgagagataccacgaccggtgctcgatttagtacacacacttagggattggggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagcccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctacttcttttctcttcggaactgggaccacggtcaccgtcctaggtcagcccaaggccaaccccatgtcactctgttcccacctcctcgtatctctcg

SEQ ID NO: 601762 - DNA, 513 bp, Homo sapiens
  misc_feature: HIJSMM301AOFKR.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcgccaggaccaaggtggcaatcaacgaactgtggctgcaccatctgtcttcatcttcccg

SEQ ID NO: 601763 - DNA, 484 bp, Homo sapiens; identical to SEQ ID NO: 535400
  misc_feature: HIJSMM301DL76Z.46.26.C04.1.454.light.4.raw

SEQ ID NO: 601764 - DNA, 522 bp, Homo sapiens
  misc_feature: HIJSMM301AK243.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcgggcggagggaccaggctgaccgtcctaggtcagcccaaggctgccccctcggtcactctgttcccgccct

SEQ ID NO: 601765 - DNA, 501 bp, Homo sapiens
  misc_feature: HIJSMM301DLQ42.51.35.D02.1.454.light.4.raw
cgatcgtatacacgaccggtgctcgatttagcacacgatagttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcagcatcacttgccgggccactgagaatattcataattggttggcctggtatcagcagaaaccagggaaagcccctaaactcctgatatataagacgtctaatttagaaggtggggtcccatcaaggttcagcggcggtggctctgggacagaattcactctcaccatcaccagcctgcagcctgatgattttgcaacttattactgccaacagtattatagttattggacgtttcggccaagggaccaaggtggaaatcaaacgaactagtggctgcaccatctgtcttcatcttccccg

SEQ ID NO: 601766 - DNA, 484 bp, Homo sapiens; identical to SEQ ID NO: 551212
  misc_feature: HIJSMM301DQYIL.3.10.A10.1.454.light.4.raw

SEQ ID NO: 601767 - DNA, 447 bp, Homo sapiens; identical to SEQ ID NO: 535201
  misc_feature: HIJSMM301AT8UZ.18.9.A09.1.454.light.4.raw

SEQ ID NO: 601768 - DNA, 497 bp, Homo sapiens; identical to SEQ ID NO: 535286
  misc_feature: HIJSMM301AEFP8.18.59.F04.1.454.light.4.raw

SEQ ID NO: 601769 - DNA, 492 bp, Homo sapiens
  misc_feature: HIJSMM301B7NG0.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgctagtttattactgtcagcagtataataactggttcctgctcactttcggcgggggaccaggtggagatcaacgaactgtggctgcaccatctgtt

SEQ ID NO: 601770 - DNA, 471 bp, Homo sapiens
  misc_feature: HIJSMM301B7O7O.3.38.D05.1.454.light.4.raw
agacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtgggtcccatcaaggttcagtggcagtggatctgggacagatttcactctcaccatcaacagtctgcaacctgaagattttgcaacttactactgtcaacagagtttcactacccctctcactttcgcggggggaccaaggtggagatcaaacgaa

SEQ ID NO: 601771 - DNA, 495 bp, Homo sapiens
  misc_feature: HIJSMM301C2X7V.12.87.H10.1.454.light.4.raw
atacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcattgggggaaaagtttgctttctggtatcagcagaagccaggccagtcccctgtcttggtcatctataaggatagcaggcggcctcagggattcctgagcgattctccggctccaactccggcaacacagccactctgaccatcagcgggaccaggctctcgatgaggctgactattactgccaggcgtgggacagctccacttcccgttattgtcttcggaggtgggaccatggtcaccgtcctaggtcagcccaagaccaacccactgt

SEQ ID NO: 601772 - DNA, 491 bp, Homo sapiens; identical to SEQ ID NO: 535194
  misc_feature: HIJSMM301C3YCJ.26.78.H01.1.454.light.4.raw

SEQ ID NO: 601773 - DNA, 424 bp, Homo sapiens
  misc_feature: HIJSMM301CKW3D.41.82.H05.1.454.light.4.raw
tctatactatcacgaccggtgctcgatttagtcgagctctctcgcgggcacgaccggtgctcgatttagtctagcgactttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgttcaccagtatggtagttcacctctaaactttcggcggagggaccaaggtggaggatcaaacgaactgtggctgcaccatctgtcttcatcttcccgccatctgaatagtataga

SEQ ID NO: 601774 - DNA, 494 bp, Homo sapiens; identical to SEQ ID NO: 535276
  misc_feature: HIJSMM301ARE0X.16.6.A06.1.454.light.4.raw

SEQ ID NO: 601775 - DNA, 498 bp, Homo sapiens
  misc_feature: HIJSMM301EPI63.21.8.A08.1.454.light.4.raw
tcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgccaaaagaatatacttgttggttccagcagaagtcaggccaggcccctgtactggtcatccatgaggccagtcgacgacactccgggatccctgagagattctctgcctccagctcagggacagtggccaccttgactatcagtgggcccaggtggacgatgaagctgactactattgttacgcaccagacagtagtggtcatcagggggtattcggcggagggaccaagttgaccgtccttggtcagcccaaggctgccccctcggtcactctcg

SEQ ID NO: 601776 - DNA, 493 bp, Homo sapiens; identical to SEQ ID NO: 535047
  misc_feature: HIJSMM301A9AJG.16.53.E09.1.454.light.4.raw

SEQ ID NO: 601777 - DNA, 496 bp, Homo sapiens; identical to SEQ ID NO: 586258
  misc_feature: HIJSMM301D06F2.51.83.H06.1.454.light.4.raw

SEQ ID NO: 601778 - DNA, 482 bp, Homo sapiens
  misc_feature: HIJSMM301CUYQI.26.70.G04.1.454.light.4.raw
agactatactcacgaccggtgctcgatttagtgtagtgtgaagggaaagggggcaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgtcgggcgagtcagggcattagcgattttttagcctggtttcagcagaaaccagggaaagcccccaagtccctgatctatgctgcgtccactttagaaggtggagtcccatcaaggttcagcggcagtggatctgggacagagttcactctcaacatcagcagcctgcagcctgaggattttgcaacttattactgccagcagtataatgattaccctatcaccttcggccggggacacggctggaactaacgaactgtggctgcacc

SEQ ID NO: 601779 - DNA, 495 bp, Homo sapiens; identical to SEQ ID NO: 535486
  misc_feature: HIJSMM301AFWNX.26.72.G06.1.454.light.4.raw

SEQ ID NO: 601780 - DNA, 502 bp, Homo sapiens
  misc_feature: HIJSMM301ESNGP.2.49.E05.1.454.light.4.raw
acgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagagcggcccccaagctcctcatctatagaaattatgaacggtcctcaggggtccctgaccgattctctggctccaagtctggcacctcagcctccctggccatcagtgggctccggtccgaggatgaggctgattattactgtgttggatggggacagcagcctgagtgcttatgtcttcggaactgggaccacggtcaccgtcctaggt

SEQ ID NO: 601781 - DNA, 511 bp, Homo sapiens; identical to SEQ ID NO: 549024
  misc_feature: HIJSMM301CANRG.14.7.A07.1.454.light.4.raw

SEQ ID NO: 601782 - DNA, 503 bp, Homo sapiens; identical to SEQ ID NO: 538884
  misc_feature: HIJSMM301D7YJD.27.78.H01.1.454.light.4.raw

SEQ ID NO: 601783 - DNA, 494 bp, Homo sapiens; identical to SEQ ID NO: 534992
  misc_feature: HIJSMM301BW0E0.9.1.A01.1.454.light.4.raw

SEQ ID NO: 601784 - DNA, 501 bp, Homo sapiens
  misc_feature: HIJSMM301ERCZ1.8.55.E11.1.454.light.4.raw
ctcgcgtgtccacgaccggtgctcgatttagcactcgcacgttgggtttggggagctctgcttcagctgtgagcgcagaaggcaggactcgggacaatcgtcatcatgacctgctcccctctcctcctcacccttctcattcactgcacagggtcctgggcccagcctgtgttgacgcaggcgccctcagtatctgcggccccgggacagagggtcaccatctcctgctccggaagcacctcaaatattggggacagttttgtatcgtggtatcagcaagtccccggaacagcccccaaactcctcatttatgaggataatgagcgacgttcaggaattcctgaccgtttctctggctccaagtctggcacgtcagccaccctgggcatcaccggactccagactggggacgaggccgactattactgcggagcatgggatagcagcctgaacactgtggtcttcggcggagggaccaaggctgaccgtcttagtcagccc

SEQ ID NO: 601785 - DNA, 380 bp, Homo sapiens; identical to SEQ ID NO: 540540
  misc_feature: HIJSMM301DTR5Z.12.78.H01.1.454.light.4.raw

SEQ ID NO: 601786 - DNA, 465 bp, Homo sapiens
  misc_feature: HIJSMM301AGTH8.26.78.H01.1.454.light.4.raw
agactatactcacgaccggtgctcgatttagtgtgagtagtttgggtttgggggagggaactgctcagttaggacccagagggaaccatggaagccccagctcagcttctcttcctcctgctactctggctcccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggagatcagacgaactgtggctgcaccatctgtcttcatcttcccgccatctgaagtatagtct

SEQ ID NO: 601787 - DNA, 497 bp, Homo sapiens; identical to SEQ ID NO: 536376
  misc_feature: HIJSMM301A47O9.22.9.A09.1.454.light.4.raw

SEQ ID NO: 601788 - DNA, 512 bp, Homo sapiens
  misc_feature: HIJSMM301B67CW.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggtccgacgggaccggaacgacgtggaggagtcaaacgaaactagtggcgtgcacccactcttcgtcttt

SEQ ID NO: 601789 - DNA, 496 bp, Homo sapiens
  misc_feature: HIJSMM301ASVG0.52.86.H09.1.454.light.4.raw
cgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagccaaggccaaccccactcgtcact

SEQ ID NO: 601790 - DNA, 505 bp, Homo sapiens
  misc_feature: HIJSMM301EOOQL.51.28.C06.1.454.light.4.raw
cgatcgtatacacgaccggtgctcgatttagagctcacgtattgggtttgggggaggaactgctcagttaggacccagagggaaccatggaagccccagctcagcttctcttcctcctgctactctggctcccagattccaccggagaaattgtgttgacacagtctccaggcaccctgtctttgtctccaggggaaagagccaccctctcctgcagggccagtcagagtgttagtcacttcttagcctggtaccaacacaaacctggccaggctcccaggctcctcatttatgatgcatccaagagggccactggcgtcccagccaggttcagtggcagtgggtctggggacagacttcactctcaccatcagcagcctagagcctgaagattttgcagtttattactgtcagcagcgtaacaactggctctctttcggcggagggaccaaggtggagatcaaacgaactgtggctgcaccatctgtcttcatcttcccgccta

SEQ ID NO: 601791 - DNA, 492 bp, Homo sapiens; identical to SEQ ID NO: 535126
  misc_feature: HIJSMM301BJOTP.18.11.A11.1.454.light.4.raw

SEQ ID NO: 601792 - DNA, 493 bp, Homo sapiens
  misc_feature: HIJSMM301EJQO9.26.14.B03.1.454.light.4.raw
agactatactcacgaccggtgctcgatttagtgtgagtagtttgggtttaggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccgagggtggaggatcagacgaactgtggctgcaccatctgtt

SEQ ID NO: 601793 - DNA, 503 bp, Homo sapiens; identical to SEQ ID NO: 535044
  misc_feature: HIJSMM301DG1PG.19.78.H01.1.454.light.4.raw

SEQ ID NO: 601794 - DNA, 507 bp, Homo sapiens; identical to SEQ ID NO: 560339
  misc_feature: HIJSMM301EX5A0.47.83.H06.1.454.light.4.raw

SEQ ID NO: 601795 - DNA, 482 bp, Homo sapiens
  misc_feature: HIJSMM301DHD0T.14.11.A11.1.454.light.4.raw
cgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccgggcaagtcagttcattagaatgagttaggctggtatcagcagaaaccagggaaagcccctaagctcctgatctatgctgcgtccaatttacaaactggggtcccatcaaggttcagcggcagtggatctggcacagatttcactctcaccatcagcagcctgcagcctgaagattttgcaacttattactgtctacaagattacaattaccctcgaacgttcggccaagggaccgaaggtggaagtacaacgaactcgtggctgcaccat

SEQ ID NO: 601796 - DNA, 461 bp, Homo sapiens
  misc_feature: HIJSMM301C4CZ4.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgaatttattactgtgcagcatgggattacaacctgagtgatcctagttgggtgttcggcggagggaccaggctgaccgtcctaggtcagcccaaggctgccccctggtcactctgttcccaccctcctcacgcgtatgt

SEQ ID NO: 601797 - DNA, 496 bp, Homo sapiens
  misc_feature: HIJSMM301ESW67.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttatattgtcagcaatattatattcctcctcagtacgttcggccaagggaccaaggtggaaatcaaacgaactgtggctgcacc

SEQ ID NO: 601798 - DNA, 487 bp, Homo sapiens; identical to SEQ ID NO: 576586
  misc_feature: HIJSMM301C49AH.7.85.H08.1.454.light.4.raw

SEQ ID NO: 601799 - DNA, 478 bp, Homo sapiens
  misc_feature: HIJSMM301D319I.3.38.D05.1.454.light.4.raw
agacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactacccctctcactttcggcggggggaccaaggtggagatcaaacgaacgtgt

SEQ ID NO: 601800 - DNA, 487 bp, Homo sapiens
  misc_feature: HIJSMM301A6SJG.46.35.D02.1.454.light.4.raw
actagcagtacacgaccggtgctcgatttagcacacgatagttgggtttgggggagctgctcagttaggacccagagggaaccatggaaaccccagcgcagcttctacttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcaccat

SEQ ID NO: 601801 - DNA, 503 bp, Homo sapiens; identical to SEQ ID NO: 547049
  misc_feature: HIJSMM301BRNM3.18.59.F04.1.454.light.4.raw

SEQ ID NO: 601802 - DNA, 494 bp, Homo sapiens; identical to SEQ ID NO: 535276
  misc_feature: HIJSMM301DP0QQ.16.6.A06.1.454.light.4.raw

SEQ ID NO: 601803 - DNA, 475 bp, Homo sapiens; identical to SEQ ID NO: 548160
  misc_feature: HIJSMM301CJCFT.52.1.A01.1.454.light.4.raw

SEQ ID NO: 601804 - DNA, 464 bp, Homo sapiens; identical to SEQ ID NO: 536640
  misc_feature: HIJSMM301CCQ96.26.78.H01.1.454.light.4.raw

SEQ ID NO: 601805 - DNA, 440 bp, Homo sapiens
  misc_feature: HIJSMM301CBB8J.18.9.A09.1.454.light.4.raw
tacgagtatgcacgaccggtgctcgatttagcgagacgcgcagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaacccactgtcattctgttcccgccctcctccatactcgta

SEQ ID NO: 601806 - DNA, 494 bp, Homo sapiens; identical to SEQ ID NO: 534992
  misc_feature: HIJSMM301ARTI9.9.1.A01.1.454.light.4.raw

SEQ ID NO: 601807 - DNA, 503 bp, Homo sapiens
  misc_feature: HIJSMM301DXHOP.40.60.F05.1.454.light.4.raw
tctagcgactcacgaccggtgctcgatttagtacgtcatcagggaaagggggagctgctcagttaggacccagagggaaccatggaaaccccagcgcagcttctcttcctcctgctactctggctcccagagacccccggagaaattgtgttgacgcagtctccaggcaccctgtctttgtctccaggggaaagagccaccctctcctgcagggccagtcagagtgtaaccaacaactacttaatgtggtaccagcaaaaacctggccaggctcccaggctcctcatctatggtgcatccaacagggccagtggcatcccagacaggtttagaggcagtggggccgacacagacttcactctcaccatcagcagactggagcctgaagattttgcactgtattactgtcaccagtctgctcacgtacctctcactttcggcggagggaccaaggtggagatcaaacgaactgtggctgcaccatctgtcttcatcttcccgcc

SEQ ID NO: 601808 - DNA, 496 bp, Homo sapiens
  misc_feature: HIJSMM301CBVF5.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactagaaaatcagcagagtggaggctgaggatgttggggtttattactgcatgcaagctctacaaactccttacacttttggccaggggaccaagctggagatcaaacgaactgtggcg

SEQ ID NO: 601809 - DNA, 503 bp, Homo sapiens
  misc_feature: HIJSMM301CNMN1.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcagggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtctaggtcagcccaaggccaacccactgtcta

SEQ ID NO: 601810 - DNA, 464 bp, Homo sapiens; identical to SEQ ID NO: 537214
  misc_feature: HIJSMM301CVBCH.18.59.F04.1.454.light.4.raw

SEQ ID NO: 601811 - DNA, 501 bp, Homo sapiens
  misc_feature: HIJSMM301CAIZU.41.45.E01.1.454.light.4.raw
tctatactatcacgaccggtgctcgatttagtgagtcagtaagggaaaggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtcctttatcgggtgttcggcgggggaccaagctgaccgtcctaggtcagcccaaggctgccccctcggtcact

SEQ ID NO: 601812 - DNA, 504 bp, Homo sapiens
  misc_feature: HIJSMM301DXBLG.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatggggatgacaatctgagcggttgggtgttcggcggagggaccaaactgaccgtcctaggtcagccccaa

SEQ ID NO: 601813 - DNA, 489 bp, Homo sapiens; identical to SEQ ID NO: 535180
  misc_feature: HIJSMM301D2ZKW.9.1.A01.1.454.light.4.raw

SEQ ID NO: 601814 - DNA, 508 bp, Homo sapiens; identical to SEQ ID NO: 559187
  misc_feature: HIJSMM301B0ZGR.8.33.C11.1.454.light.4.raw

SEQ ID NO: 601815 - DNA, 441 bp, Homo sapiens; identical to SEQ ID NO: 534971
  misc_feature: HIJSMM301DNL8B.11.3.A03.1.454.light.4.raw

SEQ ID NO: 601816 - DNA, 492 bp, Homo sapiens; identical to SEQ ID NO: 554344
  misc_feature: HIJSMM301D3V0Z.10.17.B06.1.454.light.4.raw

SEQ ID NO: 601817 - DNA, 495 bp, Homo sapiens; identical to SEQ ID NO: 582141
  misc_feature: HIJSMM301A97WL.49.58.F03.1.454.light.4.raw

SEQ ID NO: 601818 - DNA, 487 bp, Homo sapiens; identical to SEQ ID NO: 537009
  misc_feature: HIJSMM301D846O.12.88.H11.1.454.light.4.raw

SEQ ID NO: 601819 - DNA, 488 bp, Homo sapiens; identical to SEQ ID NO: 537124
  misc_feature: HIJSMM301CCVX3.11.25.C03.1.454.light.4.raw

SEQ ID NO: 601820 - DNA, 486 bp, Homo sapiens; identical to SEQ ID NO: 535043
  misc_feature: HIJSMM301BY89T.46.35.D02.1.454.light.4.raw

SEQ ID NO: 601821 - DNA, 444 bp, Homo sapiens; identical to SEQ ID NO: 535856
  misc_feature: HIJSMM301DVGL0.9.9.A09.1.454.light.4.raw

SEQ ID NO: 601822 - DNA, 490 bp, Homo sapiens; identical to SEQ ID NO: 536481
  misc_feature: HIJSMM301BRDHF.13.46.E02.1.454.light.4.raw

SEQ ID NO: 601823 - DNA, 463 bp, Homo sapiens; identical to SEQ ID NO: 535062
  misc_feature: HIJSMM301CJS3Q.11.73.G07.1.454.light.4.raw

SEQ ID NO: 601824 - DNA, 495 bp, Homo sapiens
  misc_feature: HIJSMM301BW9DK.12.19.B08.1.454.light.4.raw
atacgacgtacacgaccggtgctcgatttagtgagtcagtaaggggcctgaagacttttttatgggctggtcgcaccctgtgcaggagtcagtctcagtcaggacacagcatggacatgagggtccccgctcagctcctggggctcctgctactctggctccgagatgtgacatccagatgacccagtctccatcctccctgtctgcatctgtgggagacagagtcaccatcacttgccgggcaagtcagaggattagcagttatttaaattggtgtcagcagaagccagggagagcccctaaggtcctgatctatgcttcatccagtttgtaaagtggggtcccatcaaggttcagtggcagtggatctgggacagatttcactctcaccatcagcggtctgcaacctgaagattttgcaacttacttctgtcaacagagttacaatacccctccgtcacctgcggccaagggacacggctggagattaaaacg

SEQ ID NO: 601825 - DNA, 486 bp, Homo sapiens
  misc_feature: HIJSMM301C7WLZ.13.46.E02.1.454.light.4.raw
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaaggtgtctgacagggactccggggtcccagacagattcagcggcagtgggtcaggcactgatttcacactgaaaatcagcagggtggagggctgaggatgttattgggctctattattgcatgcaagcaacacactggccgtacacttttggcagggaccaagctggagatcaatgaac

SEQ ID NO: 601826 - DNA, 444 bp, Homo sapiens; identical to SEQ ID NO: 540477
  misc_feature: HIJSMM301D1N6S.17.21.B10.1.454.light.4.raw

SEQ ID NO: 601827 - DNA, 483 bp, Homo sapiens; identical to SEQ ID NO: 557999
  misc_feature: HIJSMM301D9SAI.46.26.C04.1.454.light.4.raw

SEQ ID NO: 601828 - DNA, 522 bp, Homo sapiens
  misc_feature: HIJSMM301DA7FD.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacagggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctcgttcccaccct

SEQ ID NO: 601829 - DNA, 505 bp, Homo sapiens; identical to SEQ ID NO: 535503
  misc_feature: HIJSMM301AFO6G.8.28.C06.1.454.light.4.raw

SEQ ID NO: 601830 - DNA, 505 bp, Homo sapiens; identical to SEQ ID NO: 536254
  misc_feature: HIJSMM301EDOE1.7.71.G05.1.454.light.4.raw

SEQ ID NO: 601831 - DNA, 494 bp, Homo sapiens
  misc_feature: HIJSMM301BLFAU.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtgggtcccatcaaggttcagcggcagtaggtctgggacagagttcactctcactatcagcggcctgcagcctgaagattctgcaacttattactgtctccagtatgatgcttaccctcggactttggtccaacgggaccgaacggtaggaaagtactaaacgaaactacgtggctggcaccaa

SEQ ID NO: 601832 - DNA, 514 bp, Homo sapiens
  misc_feature: HIJSMM301DJBLY.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggaccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccgccctcct

SEQ ID NO: 601833 - DNA, 485 bp, Homo sapiens; identical to SEQ ID NO: 539511
  misc_feature: HIJSMM301AM129.19.71.G05.1.454.light.4.raw

SEQ ID NO: 601834 - DNA, 507 bp, Homo sapiens
  misc_feature: HIJSMM301AKLFS.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaacccccactgtca

SEQ ID NO: 601835 - DNA, 490 bp, Homo sapiens
  misc_feature: HIJSMM301C0HPG.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcggcctccggggtcctaacagttcagtggcagtggatcaggcacagattttacactgaaaatcagcagagtggaggctgaggatgttggggtttattactgcatgcaagctctacaacctctgcggactttcggcctgggaccaaagtggagatcaaacgaactgtggctgcaccatctgtctt

SEQ ID NO: 601836 - DNA, 504 bp, Homo sapiens; identical to SEQ ID NO: 535561
  misc_feature: HIJSMM301AT6WM.4.57.F02.1.454.light.4.raw

SEQ ID NO: 601837 - DNA, 515 bp, Homo sapiens; identical to SEQ ID NO: 586020
  misc_feature: HIJSMM301DGS1I.43.23.C01.1.454.light.4.raw

SEQ ID NO: 601838 - DNA, 523 bp, Homo sapiens
  misc_feature: HIJSMM301BBSI7.43.81.H04.1.454.light.4.raw
tgtgagtagtcacgaccggtgctcgatttagtagtgtagattcgcggggggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttgggggcaaagctgccctgacactgtcaggtgtgcaccctgaggacgaggctgagtattactgtctgctccactttcgtactgcctgggtcgttcggcgggggacgtcagttgaccgtcctaggtcagcccaaggctcgccccctcggtccactctgttcccaccctccctcactactca

SEQ ID NO: 601839 - DNA, 505 bp, Homo sapiens
  misc_feature: HIJSMM301B8VZI.5.24.C02.1.454.light.4.raw
atcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtctaggtcagcccaaggctgccccccg

SEQ ID NO: 601840 - DNA, 479 bp, Homo sapiens; identical to SEQ ID NO: 542895
  misc_feature: HIJSMM301BBS0N.40.59.F04.1.454.light.4.raw

SEQ ID NO: 601841 - DNA, 493 bp, Homo sapiens; identical to SEQ ID NO: 536705
  misc_feature: HIJSMM301C97CM.10.33.C11.1.454.light.4.raw

SEQ ID NO: 601842 - DNA, 509 bp, Homo sapiens
  misc_feature: HIJSMM301DCAVI.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccaggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggtccggggaccgaccgtggaaatcaaacgaactagtggctgcaccatctgtctt

SEQ ID NO: 601843 - DNA, 487 bp, Homo sapiens; identical to SEQ ID NO: 536536
  misc_feature: HIJSMM301BXNQE.26.45.E01.1.454.light.4.raw

SEQ ID NO: 601844 - DNA, 510 bp, Homo sapiens
  misc_feature: HIJSMM301C4T6V.9.37.D04.1.454.light.4.raw
tgatacgtctcacgaccggtgctcgatttagtagcatactgttgggtttgggggtgtggtggtgcctcagccatggcctggaccgttctcctcctcggcctcctctctcactgcacaggctctgtgacctcctacgtgctgactcagccacccttggtgtcagtggccccaggaaagacggccaccattacgtgtgggggatacaacattggaagtaaaagtgttcactggtaccagcagaagccaggccaggcccctgtgttggtcgtctatgatgatacagaccggccctcagggatccctgagcgattctctggctccaattctggtgacacggccaccctgatcatcagcagggtcgaggtcgaggatgaggccgactattactgtcaggtgtgggatagtggtactgatcattgggtgttcggcggagggaccaagctgaccgtcctaggtcagcccaaggctgccccctcggtcactctgttcccaccctcctcagacgtatca

SEQ ID NO: 601845 - DNA, 474 bp, Homo sapiens
  misc_feature: HIJSMM301EM9N3.52.1.A01.1.454.light.4.raw
cgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggttcagtggcagtggatctgggacagaattcactctcaccatcaccagtctgcaggctgaggattttgcaacttacttctgtcaacagagttacagttccctcactttcggcctgggaccatagtggatatcaaacgaactgtggctgcaccatctgtcttcatcttcccgccat

SEQ ID NO: 601846 - DNA, 506 bp, Homo sapiens
  misc_feature: HIJSMM301BFQIN.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcacgttcggccaagggaccaaggtggaagtcaagcgaactgtggctgcaccatctgtctcatcttcccgcc

SEQ ID NO: 601847 - DNA, 475 bp, Homo sapiens
  misc_feature: HIJSMM301DDMJH.48.85.H08.1.454.light.4.raw
agtatacatacacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacaatcacctgcactgggaacaacaataatgtcgccaaccaaggagcagcttggctgcagcagcaccagggccaccctcccaaagtcgtatccgacagggataacaatcggcccttagggatctcagagagaatatctgcatccaggtcaggaaacacagcctccctgaccattactggactccaacctgaggacgaggctgactattattgctcagcatgggacaccagcctcaatgccgcgatattcggcgcagggaccaagctgaccgtcct

SEQ ID NO: 601848 - DNA, 485 bp, Homo sapiens
  misc_feature: HIJSMM301CU1FG.17.25.C03.1.454.light.4.raw
cgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacagttcccctcgcacttttggccagggaccaagttgagatcaaacgaactgtggctgcaccatctgtt

SEQ ID NO: 601849 - DNA, 482 bp, Homo sapiens
  misc_feature: HIJSMM301EJIT9.53.85.H08.1.454.light.4.raw
cgcgtatacacacgaccggtgctcgatttagtatcactcagtcgcgggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcacgttatgatgtacactggtaccagcaccttccaggagcagcccccaacctcctcctctctggtaacaccaatcggccctcaggggtccctgaccgattctctggctcgaagtctggcacctcagcctccctggccatcactggcctccaggctgaggatgaggctgattattactgccagtccctatgacagcagcctgaatgcttatgtcttcggaactgggaccaaggtcacccg

SEQ ID NO: 601850 - DNA, 513 bp, Homo sapiens
  misc_feature: HIJSMM301CTS70.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctacttactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctggtcactctgttcccaccctcctcgagtagtaca

SEQ ID NO: 601851 - DNA, 506 bp, Homo sapiens
  misc_feature: HIJSMM301ENW6Y.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgggtcagcccaaggctgccccctcggtcactctgttcccaccctccctctacgtcgtat

SEQ ID NO: 601852 - DNA, 490 bp, Homo sapiens; identical to SEQ ID NO: 538273
  misc_feature: HIJSMM301D02YE.16.73.G07.1.454.light.4.raw

SEQ ID NO: 601853 - DNA, 492 bp, Homo sapiens; identical to SEQ ID NO: 535126
  misc_feature: HIJSMM301BB7WR.18.11.A11.1.454.light.4.raw

SEQ ID NO: 601854 - DNA, 494 bp, Homo sapiens
  misc_feature: HIJSMM301DY00H.52.60.F05.1.454.light.4.raw
cgcagtacgacacgaccggtgctcgatttagtacgtcatcagggaaaggggtgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggacactgagaggccctcagggatccctgagcgattctctggctccacctcagggacactagtcacgttgaccatcagtggagtccaggcagaggacgaggctgactaccactgtcaatcaacagacagcagtggttcttatgtcttcgcaactgggaccaaggtcaccgtcctaggtcagcccaaggccaacccactgtcact

SEQ ID NO: 601855 - DNA, 476 bp, Homo sapiens; identical to SEQ ID NO: 538026
  misc_feature: HIJSMM301BXD3A.13.76.G10.1.454.light.4.raw

SEQ ID NO: 601856 - DNA, 505 bp, Homo sapiens
  misc_feature: HIJSMM301C9M0R.19.67.G01.1.454.light.4.raw
  modified_base (437)..(437): a, c, t, g, unknown or other
tactctcgtgcacgaccggtgctcgatttagagtatacatattgggtttggggggtagctcaggaagcagagcccggagcatctccactatggcctgggctccactacttctcaccctcctcgctcactgcacaggttcttgggccaactttatgctgactcagccccactctgtgtcggagtctccggggaagacggtaaccatcttttgcacccacaacagtggcaacattgccagcaattttgtgcagtggtaccagcagcgcccgggcagttcccccaccattgtgatctatgaggataatcaaagaccgtctggggtccctgatcggttctctggctccatcgacagctcctccaactctgcctccctcaccatctctggactgaagactgaggacgaggctgactactactgtcagtcttatgatagccgnggtcatgtggtcttcggcggagggaccaagctgaccgtcctaggtcagcccaaggctgccccctcggt

SEQ ID NO: 601857 - DNA, 490 bp, Homo sapiens; identical to SEQ ID NO: 535865
  misc_feature: HIJSMM301AK9HY.5.11.A11.1.454.light.4.raw

SEQ ID NO: 601858 - DNA, 443 bp, Homo sapiens
  misc_feature: HIJSMM301BG1WZ.14.76.G10.1.454.light.4.raw
cgtctagtaccacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctcggtcactctgttcccaccctcctcgtactagacg

SEQ ID NO: 601859 - DNA, 495 bp, Homo sapiens; identical to SEQ ID NO: 543724
  misc_feature: HIJSMM301BMC7T.15.59.F04.1.454.light.4.raw

SEQ ID NO: 601860 - DNA, 478 bp, Homo sapiens
  misc_feature: HIJSMM301BVUNI.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactaactgtcaacagagttccactaccccaatcactttcggccctgggactgaagtgcatatgaagagaactgtggctgcaa

SEQ ID NO: 601861 - DNA, 444 bp, Homo sapiens; identical to SEQ ID NO: 535192
  misc_feature: HIJSMM301AGGU9.5.9.A09.1.454.light.4.raw

SEQ ID NO: 601862 - DNA, 498 bp, Homo sapiens
  misc_feature: HIJSMM301EI8JI.26.12.B01.1.454.light.4.raw
  modified_base (464)..(464): a, c, t, g, unknown or other
  modified_base (483)..(483): a, c, t, g, unknown or other
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattaactggctctctttcggtcggggcgacgatggngagtcaacaactatggcgngtcaccactctgttc

SEQ ID NO: 601863 - DNA, 497 bp, Homo sapiens; identical to SEQ ID NO: 536371
  misc_feature: HIJSMM301DFKNI.16.78.H01.1.454.light.4.raw

SEQ ID NO: 601864 - DNA, 486 bp, Homo sapiens
  misc_feature: HIJSMM301DXBFW.43.33.C11.1.454.light.4.raw
tgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgctgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaatttcggtcaggggaccaagttgaacatcaatcgaactgtggctgcacc

SEQ ID NO: 601865 - DNA, 407 bp, Homo sapiens
  misc_feature: HIJSMM301D4ROV.4.35.D02.1.454.light.4.raw
agcactgtagcacgaccggtgctcgatttagcacacgatagttgggtttggggtttcatgagtgcagggagacggccaggattacttgtgggggagacaacattggagataaaagtgtgcactggtaccagcagaagccaggccaggcccctctgatggtcatctatttcgatagcgaccggccctcaggaatccctgcgcgattctcggggtccaactctgggagcacggccaccctgaccatcagtagtgtcgaagccggtgatgaggccgactattactgtcaggtgtgggatagtagtggtgatcatccatacgtcttcggaactgggaccaaggtctccgtcctacgtcagcccaaggccaactccactgtcactctgttcccaccctcctcctacagtgct

SEQ ID NO: 601866 - DNA, 496 bp, Homo sapiens
  misc_feature: HIJSMM301ELDJH.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccaggggaccaagctggagatcaaacgaactgtggctgcaccatctgtctt

SEQ ID NO: 601867 - DNA, 514 bp, Homo sapiens
  misc_feature: HIJSMM301EOND3.15.76.G10.1.454.light.4.raw
  modified_base (509)..(509): a, c, t, g, unknown or other
tctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccgccctcctcnctacg

SEQ ID NO: 601868 - DNA, 488 bp, Homo sapiens
  misc_feature: HIJSMM301B43ZJ.13.87.H10.1.454.light.4.raw
tcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatctatgttgcatccactttgcaaagtggggtcccatcaaggttcagcggcagtggatctgggacagaattcactctcacaatcagcagcctgcagcctgaagattttgcaacttattactgtcaacagcttaatagttacccgctcagtttcggcggagggaccaaggtgagatcaaacgaactgtggctgcaccatctgtcttcta

SEQ ID NO: 601869 - DNA, 488 bp, Homo sapiens; identical to SEQ ID NO: 536710
  misc_feature: HIJSMM301DQ2Z5.21.55.E11.1.454.light.4.raw

SEQ ID NO: 601870 - DNA, 505 bp, Homo sapiens; identical to SEQ ID NO: 536254
  misc_feature: HIJSMM301CW1FP.7.71.G05.1.454.light.4.raw

SEQ ID NO: 601871 - DNA, 486 bp, Homo sapiens
  misc_feature: HIJSMM301EV3U4.52.5.A05.1.454.light.4.raw
cgcagtacgacacgaccggtgctcgatttagatagatagacagggggggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattgggggatatacatgtttcctggtatcagcagaagccaggccagtctcctgttctcctcatctataaagatgtcaagcggccctcagggatccctgagcgattctctggctccaattctggaaatgcagccactctgaccatcagcgggacccagcctatggatgaggctgactattactgtcaggcgtgggacagtaggtttgtgcttttcggcggtagggaccaagctgaccgtcctacgtcagcccaaggctgccccctcggtcta

SEQ ID NO: 601872 - DNA, 510 bp, Homo sapiens
  misc_feature: HIJSMM301BTVEY.52.28.C06.1.454.light.4.raw
cgcagtacgacacgaccggtgctcgatttagagctcacgtattgggtttgggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcctgcatagtaatggaaacaactatttgaattggttcctgcagaagccagggcagtctccacaactcctaatctattggggttctattcgggcctccggggtccctgacaggttcagtggcagtgggtcaggcacagattttacactgagaatcaccagagtggaggctgaagattttggggtttatttctgcatgcaaagtctacacacaccctggacgttcggccaagggaccaacggtaggaaatacaaacgaactagtggctgcaccactctgtt

SEQ ID NO: 601873 - DNA, 493 bp, Homo sapiens
  misc_feature: HIJSMM301EPV7S.11.81.H04.1.454.light.4.raw
cgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttttactgtcagcagtatagtaactggcctccgtacacttttggccagggaccaagctagaaatcaaacgaactgtggctgcaccatctgtcttcta

SEQ ID NO: 601874 - DNA, 489 bp, Homo sapiens
  misc_feature: HIJSMM301BGL24.11.12.B01.1.454.light.4.raw
cgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaaataccaggcggccctctggggtccctgagcgattctccggctccggctctgggaacacagtcactctgaccatcagcgggacccaggctattgatgaggctgtctacttctgtcaggcgtgggacaacagcgtggtgttcggcggaggaccagtctgaccgtcttaggtcagcccaagg

SEQ ID NO: 601875 - DNA, 496 bp, Homo sapiens; identical to SEQ ID NO: 559735
  misc_feature: HIJSMM301DBQM7.13.38.D05.1.454.light.4.raw

SEQ ID NO: 601876 - DNA, 509 bp, Homo sapiens; identical to SEQ ID NO: 539359
  misc_feature: HIJSMM301C1LIR.47.85.H08.1.454.light.4.raw

SEQ ID NO: 601877 - DNA, 506 bp, Homo sapiens
  misc_feature: HIJSMM301CKK65.8.34.D01.1.454.light.4.raw
ctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccactttcggccctgggaccaaagtggatatcaacgaactgtggctgcaccatctgtcttcta

SEQ ID NO: 601878 - DNA, 497 bp, Homo sapiens; identical to SEQ ID NO: 536376
  misc_feature: HIJSMM301EJH4O.22.9.A09.1.454.light.4.raw

SEQ ID NO: 601879 - DNA, 484 bp, Homo sapiens
  misc_feature: HIJSMM301AHN2Z.51.64.F09.1.454.light.4.raw
cgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaagagccaccctctcctgcagggccagtcagagtgtttctaacaacctagcctggtatcagcagaagcctggccaggctcccaggctcctcatctatggttcatccaccagggccgctgatatcccagccaggttcagtggcagtgggtctgggacagaattcactctcaccatcagcagcctgcagtctgaagattttgctagtttattactgtcagcagtatgataagtggcctccgtacacttttggccaggggaccaggctggagatacaaacgaactgtggctgcaccat

SEQ ID NO: 601880 - DNA, 497 bp, Homo sapiens
  misc_feature: HIJSMM301DYA98.40.17.B06.1.454.light.4.raw
tctagcgactcacgaccggtgctcgatttagtcgatagtgaagggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgccgggccagtcagagtattagtacctggttggcctggtatcagcagaaaccagggaaagcccctaagttcctgatctataaggcgtctagtttagaaagtggggtcccatcaaggatcagcggcagtggatctgggacagaattcactctcaccattagtagcctgcagcctgatgattttgcaacttattactgccaacaatataatgattttccgtggacgttcggccaagggaccaaggtagaaatcaaacgaactgtggctgcaccatctgtcttcatcttccgccta

SEQ ID NO: 601881 - DNA, 497 bp, Homo sapiens
  misc_feature: HIJSMM301D8MMR.43.35.D02.1.454.light.4.raw
tgtgagtagtcacgaccggtgctcgatttagcacacgatagttgggtttgggggctttgcctgggctctgctcctcctcaccctcctcactcagggcacagggtcctgggcccagtctgccctgactcagcctccctccgcgtccgggtcccctggacagtcagtcaccatctcctgcactggaagcagcagtgacattggtggttatacatatgtctcctggtaccaacagcacccaggcaaagcccccaaactcatgatttatgaggtcaataagcggccgtcaggggtccctgatcgcttctctggctccaagtctggcaacacggccaccctgaccgtctctgggctccaggctgaggatgaggctcattattactgcagctcatatacaggcaacaagaatttggtgttcggcggagggaccgagctgaccgtctaggtcagcccaaggctgccccctggtcacgctgttcccaccctcctcactactcaca

SEQ ID NO: 601882 - DNA, 447 bp, Homo sapiens; identical to SEQ ID NO: 535201
  misc_feature: HIJSMM301ASTHG.18.9.A09.1.454.light.4.raw

SEQ ID NO: 601883 - DNA, 489 bp, Homo sapiens; identical to SEQ ID NO: 544819
  misc_feature: HIJSMM301CG7SZ.11.28.C06.1.454.light.4.raw

SEQ ID NO: 601884 - DNA, 446 bp, Homo sapiens
  misc_feature: HIJSMM301DW82W.7.18.B07.1.454.light.4.raw
cgtgtctctacacgaccggtgctcgatttagtcgctgcgtaagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagttatttggctgttcggcggcgggaccaagttgaccgtcctacgtcagcccaaggctgccccctcggtcactctgttccccaccctcctctagagacacg

SEQ ID NO: 601885 - DNA, 498 bp, Homo sapiens
  misc_feature: HIJSMM301B81O8.47.64.F09.1.454.light.4.raw
  modified_base (441)..(441): a, c, t, g, unknown or other
  modified_base (458)..(458): a, c, t, g, unknown or other
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcacttcgtcggnggacgacggtggagganctaacgaactagtggcgtgcgaccactctcgtcttctact

SEQ ID NO: 601886 - DNA, 517 bp, Homo sapiens
  misc_feature: HIJSMM301C87AE.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgttcggccgagggaccgacgacgtagaaaagtagaaggacgaacgtacgttggctgcgaccatctgtcttactattcttcccgt

SEQ ID NO: 601887 - DNA, 494 bp, Homo sapiens
  misc_feature: HIJSMM301A1YSC.43.87.H10.1.454.light.4.raw
tgtgagtagtcacgaccggtgctcgatttagcagtactgcgttgggtttgggagggtggccctgggctctgctcctcctgaccctcctcactcactctgcagtgtcagtggtccaggcagggctgactcagccaccctcggtgtccaagggcttgagacagaccgccacactcacctgcactgggaacagcaacaatgttggcaaccaaggagcagcttggctgcagcagcaccagggccaccctcccaaactcctatcctacaggaataacaaccggccctcagggatctcagagagattatctgcatccaggtcaggaaacacagcctccctgaccattactggactccagcctgaggacgaggctgactattactgctcagcatgggacagcagcctcagtgcttgggtgttcggcggagggaccaagctgaccgtcctaggtcagcccaaggctgccccctcggtcactctgttcccgccctcctcacta

SEQ ID NO: 601888 - DNA, 489 bp, Homo sapiens
  misc_feature: HIJSMM301BOW12.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacctttcggcggagggaccaaggcggagatcagacgaactgtggctgcaccatctgtcttca

SEQ ID NO: 601889 - DNA, 494 bp, Homo sapiens; identical to SEQ ID NO: 535828
  misc_feature: HIJSMM301DSVHT.3.36.D03.1.454.light.4.raw

SEQ ID NO: 601890 - DNA, 481 bp, Homo sapiens
  misc_feature: HIJSMM301CUBLF.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcgagggaccagggtggagatcagcgaa

SEQ ID NO: 601891 - DNA, 494 bp, Homo sapiens; identical to SEQ ID NO: 534994
  misc_feature: HIJSMM301C5FM6.27.78.H01.1.454.light.4.raw

SEQ ID NO: 601892 - DNA, 497 bp, Homo sapiens; identical to SEQ ID NO: 535286
  misc_feature: HIJSMM301DUL81.18.59.F04.1.454.light.4.raw

SEQ ID NO: 601893 - DNA, 494 bp, Homo sapiens
  misc_feature: HIJSMM301B4U35.49.61.F06.1.454.light.4.raw
agtcgagagacacgaccggtgctcgatttagctacgctctaagggaaagggggagaagagctgctcagttaggacccagagggaaccatggaaaccccagcgcagcttctcttcctcctgctactctggctcccagataccaccgcagaaattgtgttgacgcagtctccaggcaccctgtctttgtctccaggggaaagagccaccctctcctgcagggccagtcagagcgttagcaacagttatgtagcctggtaccagcagaaacctggccagtctcccaggctcctcatctatgctgcgtccagcagggccactggcatcccggacaggttcagtggcagtgggtctgggacagacttctctctcaccatcagcagactggagcctgaagattttgcagtttattactgtcagcagcgtagcaatttgatcaccttcggccaagggacacgactggaaattaaacgaactgtggctgcaccatctgtctt

SEQ ID NO: 601894 - DNA, 508 bp, Homo sapiens; identical to SEQ ID NO: 541821
  misc_feature: HIJSMM301DN1F1.5.60.F05.1.454.light.4.raw

SEQ ID NO: 601895 - DNA, 488 bp, Homo sapiens; identical to SEQ ID NO: 535125
  misc_feature: HIJSMM301C0HVZ.17.25.C03.1.454.light.4.raw

SEQ ID NO: 601896 - DNA, 494 bp, Homo sapiens
  misc_feature: HIJSMM301D0MAS.10.79.H02.1.454.light.4.raw
catagtagtgcacgaccggtgctcgatttagtgtcacacgaagggaaagggggagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcatatggtaggtcacctgggacttttggccaggggaccaagctggagatcaaacgaactgtggctgcaccatctgtcttcta

SEQ ID NO: 601897 - DNA, 507 bp, Homo sapiens; identical to SEQ ID NO: 538313
  misc_feature: HIJSMM301DCR0A.7.71.G05.1.454.light.4.raw

SEQ ID NO: 601898 - DNA, 503 bp, Homo sapiens; identical to SEQ ID NO: 556376
  misc_feature: HIJSMM301AXM7K.48.38.D05.1.454.light.4.raw

SEQ ID NO: 601899 - DNA, 480 bp, Homo sapiens
  misc_feature: HIJSMM301AL9SQ.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcattctcaccatcagcagcctgcagtctgaagattttgcagtttattactgtcagcactataataactggcctccgtacagttttggccaggggaccaagctggagatcaaacgaa

SEQ ID NO: 601900 - DNA, 489 bp, Homo sapiens; identical to SEQ ID NO: 567635
  misc_feature: HIJSMM301CZQEA.43.34.D01.1.454.light.4.raw

SEQ ID NO: 601901 - DNA, 448 bp, Homo sapiens; identical to SEQ ID NO: 540364
  misc_feature: HIJSMM301B1Y7Y.18.9.A09.1.454.light.4.raw

SEQ ID NO: 601902 - DNA, 487 bp, Homo sapiens
  misc_feature: HIJSMM301AT1RF.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaaccttccggccaggggacacgactggagattaaacgaactgtggctgcaccatctgtt

SEQ ID NO: 601903 - DNA, 484 bp, Homo sapiens; identical to SEQ ID NO: 535211
  misc_feature: HIJSMM301DDM0G.47.46.E02.1.454.light.4.raw

SEQ ID NO: 601904 - DNA, 512 bp, Homo sapiens
  misc_feature: HIJSMM301C27EX.14.78.H01.1.454.light.4.raw
cgtctagtaccacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgcaactaatggtgagattgggacttataaccttgtctcctggtaccaacaacatccagacaaagcccccaaactcatcatttatgagaccactaagcggccctcaggggtttctgatcgcttctctgcctccaagtctggccacacggcctccctgacaatctctgggctccagactgaggacgagggtgattattactgctgctcatacggagggactagaactttgctattcggcggagggaccaagttgaccgtcctaagtcagcccaaggctgccccctggtcactctgtt

SEQ ID NO: 601905 - DNA, 488 bp, Homo sapiens; identical to SEQ ID NO: 550614
  misc_feature: HIJSMM301BYUQ0.3.55.E11.1.454.light.4.raw

SEQ ID NO: 601906 - DNA, 485 bp, Homo sapiens; identical to SEQ ID NO: 570229
  misc_feature: HIJSMM301ADQG9.47.60.F05.1.454.light.4.raw

SEQ ID NO: 601907 - DNA, 479 bp, Homo sapiens
  misc_feature: HIJSMM301DDS37.48.86.H09.1.454.light.4.raw
agtatacatacacgaccggtgctcgatttagtgctatagacttgggtttggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcacataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagcccaac

SEQ ID NO: 601908 - DNA, 498 bp, Homo sapiens; identical to SEQ ID NO: 544759
  misc_feature: HIJSMM301C2GJV.3.71.G05.1.454.light.4.raw

SEQ ID NO: 601909 - DNA, 510 bp, Homo sapiens; identical to SEQ ID NO: 535474
  misc_feature: HIJSMM301CNNWR.17.33.C11.1.454.light.4.raw

SEQ ID NO: 601910 - DNA, 490 bp, Homo sapiens
  misc_feature: HIJSMM301BUHVX.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccgaacggaccaaggtaggaactacaaacgaa

SEQ ID NO: 601911 - DNA, 483 bp, Homo sapiens
  misc_feature: HIJSMM301BWS2R.41.37.D04.1.454.light.4.raw
tctatactatcacgaccggtgctcgatttagtagcatactgttgggtttgggggatcaggacttctcagttcatcttctcaccatgaggctccctgctcagctcctggggctgctaatgctctggatacctggatccagtgcagatattgtgatgtcccagactccactctctctgtccgtcacccctggacagccggcctccatctcctgcaagtctagtcagagtctcctccatgagaatggcaaaacttatttctactggtacctacagaaggcaggccagccgccacagctcctgatctatgaggttttcaggcggttctctggagtgccagacaggttcagtggcagcgggtccgggacagatttcacactgaggatcagtcgggtggaggctgacgacgttgggacttattactgcgcgcaaagtctacaccttcctctcactttgggccctgggaccaaagtggacatcaaacgaa

SEQ ID NO: 601912 - DNA, 529 bp, Homo sapiens
  misc_feature: HIJSMM301EKIC6.27.23.C01.1.454.light.4.raw
agcgtcgtctcacgaccggtgctcgatttagtacacgtgattagggagttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttcctgatcgcttctatggctccaagtctgcctacacggcctcctgaccatctccgggctccagcctgaggacgaggctgattattattgtagttcatatacaaccagtgacacttgggtgttcggcggagggaccaggctggaccgtcctaggtcagcccaaggctcgccccctcggtccactctgttcccgccttcccg

SEQ ID NO: 601913 - DNA, 485 bp, Homo sapiens; identical to SEQ ID NO: 535880
  misc_feature: HIJSMM301E01IT.7.75.G09.1.454.light.4.raw

SEQ ID NO: 601914 - DNA, 503 bp, Homo sapiens; identical to SEQ ID NO: 538884
  misc_feature: HIJSMM301AT2IV.27.78.H01.1.454.light.4.raw

SEQ ID NO: 601915 - DNA, 503 bp, Homo sapiens; identical to SEQ ID NO: 538973
  misc_feature: HIJSMM301CEHOC.5.86.H09.1.454.light.4.raw

SEQ ID NO: 601916 - DNA, 484 bp, Homo sapiens
  misc_feature: HIJSMM301D8JB4.14.55.E11.1.454.light.4.raw
cgtctagtaccacgaccggtgctcgatttagcactcgcacgttgggtttggggagtctcagtcaggacacagcatggacatgagggtcctcgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcgagggaccaaggcgagatcagacgaactgtggctgcaccatctgtctt

SEQ ID NO: 601917 - DNA, 489 bp, Homo sapiens
  misc_feature: HIJSMM301BJ5MI.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctaacaaacttcctactactttggccaggggaccaagctggagatacaaacgaa

SEQ ID NO: 601918 - DNA, 495 bp, Homo sapiens; identical to SEQ ID NO: 568821
  misc_feature: HIJSMM301A3C9D.27.78.H01.1.454.light.4.raw

SEQ ID NO: 601919 - DNA, 488 bp, Homo sapiens; identical to SEQ ID NO: 535081
  misc_feature: HIJSMM301EDZTO.26.23.C01.1.454.light.4.raw

SEQ ID NO: 601920 - DNA, 475 bp, Homo sapiens
  misc_feature: HIJSMM301D8TRD.8.85.H08.1.454.light.4.raw
ctcgcgtgtccacgaccggtgctcgatttagtatcactcagtcgcgggggagtcagtctcagtcaggacacagcatggacatgagggtccccgctcagctcctggggctcctgctactctggctccgaggtgccagatgtgacatccagatgacccagtctccatcctccctgtctgcatctgtcggagacagagtcaccatcacttgtcgggcaagtcagactataaataattatttaaattggtatcagcagaaaccagggaacgcccctaagctcctcatatattctgcattcactttgcaaagtgggtcccatcaaggttcagtggcagtggatctgggacagatttcactctcaccatccgcagtctgcaacctgaagatttgcaatttattactgtcaagagactcacaatggaggcacttttggccaggggaccaagctggagaggaaacgaactgtggctgcaccat

SEQ ID NO: 601921 - DNA, 506 bp, Homo sapiens
  misc_feature: HIJSMM301B2D0S.3.79.H02.1.454.light.4.raw
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggtatttggtggagggaccaagctgaccgtctaggtcagcccaaggctgccccctcggt

SEQ ID NO: 601922 - DNA, 474 bp, Homo sapiens; identical to SEQ ID NO: 561309
  misc_feature: HIJSMM301CRO52.5.12.B01.1.454.light.4.raw

SEQ ID NO: 601923 - DNA, 520 bp, Homo sapiens
  misc_feature: HIJSMM301CNSGU.48.33.C11.1.454.light.4.raw
agtatacatacacgaccggtgctcgatttagagtgagctcgttgggtttggggggtagagaagacaggattcaggacaaactccagcatggccggcttccctctcctcctcaccctcctcactcactgtgcagggtcctgggcccagtctgtgttgactcagccaccctcaacgtctgggactcccgggcagaccgtcaccatctcttgttctggcagcagatggaacatcgggagcaattttgttcactggtaccagcaactgccaggagcggcccccaaactcctcatctacaggaatgataagcgaccctcaggggtccctgcccgattctctggctccaagtctggcaccacagcctccctggccatcagaggactccggtccgaggatgagggtgatttttattgtgctgtttgggatgacgacatgaatggttcgattttcggcggagggaccaaactgaccgtctgggtcagcccaaggctgccccctcggtcactctgttcccacctcctct

SEQ ID NO: 601924 - DNA, 509 bp, Homo sapiens
  misc_feature: HIJSMM301CZIJY.48.38.D05.1.454.light.4.raw
agtatacatacacgaccggtgctcgatttagtatctgatagttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgtattggtaccaactgaagtcaggccaggcccctgtcctggtcatttatgaggacgaccagcgaccctccaggatccctgcgaggttctctggatcgaactcagggacattggccaccttgactatcactgggcccaggtggaggatgaaggtgactacttctgtttctcaacagacaccagtgacaatcatgcgattttcggcggagggaccaagctgaccgtcctgggtcagcccaaggctgccccctcggtcactctgttcccgcct

SEQ ID NO: 601925 - DNA, 523 bp, Homo sapiens
  misc_feature: HIJSMM301A2R4K.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggcctgccccctcggtccactctcgttcccgccctccctccaccg

SEQ ID NO: 601926 - DNA, 495 bp, Homo sapiens
  misc_feature: HIJSMM301DSZ6G.22.9.A09.1.454.light.4.raw
acatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtgggtctggaagagacttcactctcaccatcaacagcctagagcctgacgattctgcagtttattactgtcagcagcgtaccaagtggctccgacttttggccaggggccaagctggagatcagacgaactgtggctgcaccatctgtcttcatcttccccg

SEQ ID NO: 601927 - DNA, 496 bp, Homo sapiens; identical to SEQ ID NO: 537925
  misc_feature: HIJSMM301EHA56.22.14.B03.1.454.light.4.raw

SEQ ID NO: 601928 - DNA, 489 bp, Homo sapiens; identical to SEQ ID NO: 535091
  misc_feature: HIJSMM301EB2Z3.47.36.D03.1.454.light.4.raw

SEQ ID NO: 601929 - DNA, 494 bp, Homo sapiens; identical to SEQ ID NO: 534992
  misc_feature: HIJSMM301AQCZE.9.1.A01.1.454.light.4.raw

SEQ ID NO: 601930 - DNA, 445 bp, Homo sapiens; identical to SEQ ID NO: 536433
  misc_feature: HIJSMM301DBW1O.5.9.A09.1.454.light.4.raw

SEQ ID NO: 601931 - DNA, 448 bp, Homo sapiens; identical to SEQ ID NO: 540364
  misc_feature: HIJSMM301BX4H3.18.9.A09.1.454.light.4.raw

SEQ ID NO: 601932 - DNA, 508 bp, Homo sapiens; identical to SEQ ID NO: 536388
  misc_feature: HIJSMM301CZJSG.11.57.F02.1.454.light.4.raw

SEQ ID NO: 601933 - DNA, 493 bp, Homo sapiens
  misc_feature: HIJSMM301ADN9S.16.9.A09.1.454.light.4.raw
tgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctggagataacctgggaagtaaatttactttctggtatcagcggaagccaggccagtcccctgttttggtcatctataaagataggaatcggccctcagacatccctgagcgattctctggctccagctctggaaacacagccactctgaccatcaccgggacccagactatggatgaagctgactattactgtcaggcgtgggacgagcggcactgtggttttcggtcggagggaccgaagctgaccgtcctcggtcagcccaaggctgccccctcggtcactct

SEQ ID NO: 601934 - DNA, 482 bp, Homo sapiens
  misc_feature: HIJSMM301EGDE0.17.34.D01.1.454.light.4.raw
cgtagactagcacgaccggtgctcgatttagatcgtctgtgttgggtttgggtcatcacaatatctgcactggatacctggatccagtgcagatattgtgatgacccagactccactctctctgtccgtcacacctggacagccggcctccatctcctgcaagtctagtcagagcctcctgcatagtggtgaaggaaagccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccaagggaccaaggtggaactcaacgaactgtggctgcaccatctgtcttcatcttcccgccatctgactagtctacg

SEQ ID NO: 601935 - DNA, 514 bp, Homo sapiens
  misc_feature: HIJSMM301DGT21.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctcgccccctggtcactctcgttcccaccctcct

SEQ ID NO: 601936 - DNA, 494 bp, Homo sapiens; identical to SEQ ID NO: 534994
  misc_feature: HIJSMM301CFK3U.27.78.H01.1.454.light.4.raw

SEQ ID NO: 601937 - DNA, 499 bp, Homo sapiens
  misc_feature: HIJSMM301CFK6M.40.9.A09.1.454.light.4.raw
tctagcgactcacgaccggtgctcgatttagcgagacgcgcagggggaagagctgctcagttaggacccagagggaaccatggaaaccccagcgcaacttctcttcctcctgctactctggctcccagaaaccaccggagaaatagtgttgaagcagtctccagacaccctgtctttgtctccaggggagagagccaccctctcctgcagggccagtcagagtgttagcagcaactccattgcctggtaccagcagaaacctggccagtctcccaggctcctcatctatggtgcttcgaccaggctcaccggcatccctgacaggttcactgccagtgggtctgggacagacttcactctcatcatcaccagactagaacctgaggattttgcagtgtattttgtcaacaacatgataagtcaccgttcagctttggccgggggacccaggtggagatcagacgaactgtggctgcaccatctgtcttcatcttccccg

SEQ ID NO: 601938 - DNA, 501 bp, Homo sapiens; identical to SEQ ID NO: 536867
  misc_feature: HIJSMM301D7XOB.5.86.H09.1.454.light.4.raw

SEQ ID NO: 601939 - DNA, 489 bp, Homo sapiens
  misc_feature: HIJSMM301CIT3O.5.34.D01.1.454.light.4.raw
atcagacacgcacgaccggtgctcgatttagatcgtctgtgttgggtttggggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagccctgcagcctgaagtattttgctaacttactattgtcaacaggactaacagtttccctccgaccttcggccaaggacgacgactggagattaaacgaactgtggctgcaccta

SEQ ID NO: 601940 - DNA, 486 bp, Homo sapiens; identical to SEQ ID NO: 535043
  misc_feature: HIJSMM301BYAVX.46.35.D02.1.454.light.4.raw

SEQ ID NO: 601941 - DNA, 497 bp, Homo sapiens
  misc_feature: HIJSMM301ASLW9.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaagggtggaaatcaaacgaactgtggctgcacc

SEQ ID NO: 601942 - DNA, 496 bp, Homo sapiens
  misc_feature: HIJSMM301E17XL.7.75.G09.1.454.light.4.raw
cgtgtctctacacgaccggtgctcgatttagtatagacatcagggggcgaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggtattttgactaacttactactgtcagcaggctaacaggctcgccccccaaccttccggcccgaggggacgacgactggagattaaacgaactgtggctgcaccatctgtt

SEQ ID NO: 601943 - DNA, 506 bp, Homo sapiens
  misc_feature: HIJSMM301C02BP.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccgggatgaggccgactattactgtcaggtgtgggatagtagtggtgatcatccatacgtcttcggaactgggaccaaggtctccgtcctacgtcagcccaaggccaacccactgtcactctgttccc

SEQ ID NO: 601944 - DNA, 512 bp, Homo sapiens; identical to SEQ ID NO: 541300
  misc_feature: HIJSMM301B1RYU.17.33.C11.1.454.light.4.raw

SEQ ID NO: 601945 - DNA, 495 bp, Homo sapiens
  misc_feature: HIJSMM301D9T58.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactggaccaaggtcaccgtctaggtcagcccaagg

SEQ ID NO: 601946 - DNA, 515 bp, Homo sapiens
  misc_feature: HIJSMM301BI4L0.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggtccaacgggaccgaacggtagggaaagtacaagacgaactagtggctggcaccatctcgtcttctatcttcccgt

SEQ ID NO: 601947 - DNA, 492 bp, Homo sapiens
  misc_feature: HIJSMM301A1NC9.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactacttacctcaagtgatcaccttcggccaagggacacgactggagattaacgaactgtggctgcaccatctgtctt

SEQ ID NO: 601948 - DNA, 516 bp, Homo sapiens
  misc_feature: HIJSMM301AXY2G.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcgccaggaccgaaggtaggaagtacgaaacgaactagtaggcgtgcgaccactctgtcttctactcttcccgtccctact

SEQ ID NO: 601949 - DNA, 510 bp, Homo sapiens
  misc_feature: HIJSMM301BJ161.16.1.A01.1.454.light.4.raw
tgtactactccacgaccggtgctcgatttagacgtctcatcagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctgccccctcggtcactctgtt

SEQ ID NO: 601950 - DNA, 503 bp, Homo sapiens
  misc_feature: HIJSMM301BH8CB.40.41.D08.1.454.light.4.raw
tctagcgactcacgaccggtgctcgatttagtcacgcgagaaagggaaagggggagagactgaagaacccagcattgcagcagctccaccatggcctgggctcctctgctcctcaccctcctcagtctcctcacagggtccctctcccagcctgtgctgactcagccaccttctgcatcagcctccctgggagcctcggtcacactcacctgcaccctgagcagcggctacagtaattataaagtggactggtaccagcagagaccagggaagggcccccggtttgtgatgcgagtgggcactggtgggattgtgggatccaagggggatggcatccctgatcgcttctcagtcttgggctcaggcctgaatcggtacctgaccatcaagaacatccaggaagaggatgagagtgactaccactgtggggcagaccatggcagtgggagcaacttcgggtgttcggcggagggaccaagctgaccgtcctaggtcagaccccg

SEQ ID NO: 601951 - DNA, 441 bp, Homo sapiens; identical to SEQ ID NO: 534971
  misc_feature: HIJSMM301B7JQI.11.3.A03.1.454.light.4.raw

SEQ ID NO: 601952 - DNA, 483 bp, Homo sapiens
  misc_feature: HIJSMM301EM3YS.21.25.C03.1.454.light.4.raw
tcgtcgctcgcacgaccggtgctcgatttagtagtgtagatttgggtttgggggctgttcccggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggctgttcggcggcgggaccag

SEQ ID NO: 601953 - DNA, 490 bp, Homo sapiens; identical to SEQ ID NO: 547347
  misc_feature: HIJSMM301CXSMR.13.39.D06.1.454.light.4.raw

SEQ ID NO: 601954 - DNA, 510 bp, Homo sapiens; identical to SEQ ID NO: 540474
  misc_feature: HIJSMM301CO4LD.5.27.C05.1.454.light.4.raw

SEQ ID NO: 601955 - DNA, 503 bp, Homo sapiens; identical to SEQ ID NO: 538973
  misc_feature: HIJSMM301EBZYM.5.86.H09.1.454.light.4.raw

SEQ ID NO: 601956 - DNA, 505 bp, Homo sapiens
  misc_feature: HIJSMM301EMPCJ.5.86.H09.1.454.light.4.raw
  modified_base (491)..(491): a, c, t, g, unknown or other
atcagacacgcacgaccggtgctcgatttagtgctatagacttgggtttggggggggtctcaggaggctagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaaggcngccccctcggtcta

SEQ ID NO: 601957 - DNA, 498 bp, Homo sapiens
  misc_feature: HIJSMM301A39XA.22.15.B04.1.454.light.4.raw
acatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaggatgaggctgattattactgcagctcatatggaggcagcgacaatttggtgttcgggcggagggaccaagctgaccgtcctaggtcagcccaaggctcgccccc

SEQ ID NO: 601958 - DNA, 496 bp, Homo sapiens; identical to SEQ ID NO: 535109
  misc_feature: HIJSMM301AY4LI.16.78.H01.1.454.light.4.raw

SEQ ID NO: 601959 - DNA, 525 bp, Homo sapiens
  misc_feature: HIJSMM301DM4IG.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcgccaggaccgaaggtaggaagtacaacgaactgtaggcgtgcgaccactactgttcttctacttccttcccgtcccactcctagtacg

SEQ ID NO: 601960 - DNA, 508 bp, Homo sapiens; identical to SEQ ID NO: 591836
  misc_feature: HIJSMM301B2I10.5.24.C02.1.454.light.4.raw

SEQ ID NO: 601961 - DNA, 491 bp, Homo sapiens
  misc_feature: HIJSMM301A8S47.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgcagtttattactgtcagcagtatgatacctggcctccgtacacttttggccggggccaagctggaaatcaagcgaactgtggctgcaccatctgtcttcatt

SEQ ID NO: 601962 - DNA, 514 bp, Homo sapiens
  misc_feature: HIJSMM301D2BJY.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagccggtgatgaggctgactattttgtcaggtgtgggacagcagcatttatgtcttcggacctgggaccaaggtcaccgtcctaggtcagcccaaggccaaccccactgtccactctgttcccaccctcctcga

SEQ ID NO: 601963 - DNA, 510 bp, Homo sapiens
  misc_feature: HIJSMM301BMY5L.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggccgaagggaccgaaggtaggaaatacaaacgaactagtggctggcaccatctgtcttctatcttccccg

SEQ ID NO: 601964 - DNA, 486 bp, Homo sapiens; identical to SEQ ID NO: 535043
  misc_feature: HIJSMM301AOQYT.46.35.D02.1.454.light.4.raw

SEQ ID NO: 601965 - DNA, 480 bp, Homo sapiens; identical to SEQ ID NO: 556526
  misc_feature: HIJSMM301CMZD7.11.76.G10.1.454.light.4.raw

SEQ ID NO: 601966 - DNA, 457 bp, Homo sapiens
  misc_feature: HIJSMM301CI6RG.41.57.F02.1.454.light.4.raw
tctatactatcacgaccggtgctcgatttagctcgatatagttgggtttggggtccaaacagagcttcagcaagcatagtgggaatctgcaccatgccctgggctctgctcctcctgaccctcctcactcacctgcactgggaacagctacaatgttggcaacgaaggagcagcttggctgcagcagtaccagggccaccctcccaaattgctatcatacaggaagaacaaccgcccctcggggatctccgagagattctctgcatcaacgtcaggaaacatagcctccctgaccattactggactccagcctgaggacgaggctgactattactgctcagcatgggacagcagcctcaatgtttgggtgttcggcggagggaccaagctgaccgtcctaggtcagcccaaggctgccccctcggtcactctgttccccgcctcctcatagtataga

SEQ ID NO: 601967 - DNA, 488 bp, Homo sapiens; identical to SEQ ID NO: 598542
  misc_feature: HIJSMM301BOJHT.19.71.G05.1.454.light.4.raw

SEQ ID NO: 601968 - DNA, 477 bp, Homo sapiens
  misc_feature: HIJSMM301AHS0D.13.76.G10.1.454.light.4.raw
tcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcggacccaggctatggatgaggctgactattactgtcaggcgtgggacagcagcactgcccgctatgtcttcggaactgggaccaaggtcaccgtcctaagtcagaccccg

SEQ ID NO: 601969 - DNA, 491 bp, Homo sapiens
  misc_feature: HIJSMM301AVKZ9.43.78.H01.1.454.light.4.raw
tgtgagtagtcacgaccggtgctcgatttagtgtgagtagtttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaatttcggtcaggggaccaagttgaacatcaatcgaactgtgctgcaccatctgt

SEQ ID NO: 601970 - DNA, 485 bp, Homo sapiens; identical to SEQ ID NO: 579022
  misc_feature: HIJSMM301D9YM1.7.75.G09.1.454.light.4.raw

SEQ ID NO: 601971 - DNA, 520 bp, Homo sapiens
  misc_feature: HIJSMM301DAX89.40.42.D09.1.454.light.4.raw
tctagcgactcacgaccggtgctcgatttagacacatacgcagggaaagggggggcctaaggaagcagcactggtggtgcctcagccatggcctggaccgttctcctcctcggcctcctctctcactgcacagggtctgtgacctcctatgtgctgactcagccactctcggtgtctgtggccccaggacaggcggccaatgttacctgtgggggagacaacattgggagtaaaagtgtgcactggtaccagctgaagccaggccaggcccctgtgttggtcgtctttggacatggtgcccgaccctcggggatccctgagcgattctctgcctccaggtctgggaacacggccaccctgaccatcaccagggtcgaggccggagatgaggccgactatttttgtcacgtgtggcacgttagtcatcacgtcttcggaactgggaccacggtcaccgtcctaagtcagcccaaggccaaccccactgtcactctgttccccaccctcctcagtcgctaga

SEQ ID NO: 601972 - DNA, 490 bp, Homo sapiens; identical to SEQ ID NO: 538999
  misc_feature: HIJSMM301EI8QH.16.86.H09.1.454.light.4.raw

SEQ ID NO: 601973 - DNA, 511 bp, Homo sapiens
  misc_feature: HIJSMM301D8WM8.27.78.H01.1.454.light.4.raw
  modified_base (500)..(500): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaatgatcaccttcggccaagggacacgtactggaggaattaaaacgtaaacctagttggcgtgacacccaatnttcggtcttta

SEQ ID NO: 601974 - DNA, 500 bp, Homo sapiens
  misc_feature: HIJSMM301A5YTX.48.67.G01.1.454.light.4.raw
agtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaagcctggccaggctcccagactcctcatctatgatgcgtctaccagggccactggcgtcccggcaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgactgtggctgcaccatctgtcttcatcttcccg

SEQ ID NO: 601975 - DNA, 521 bp, Homo sapiens
  misc_feature: HIJSMM301BGFWI.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccaacgggaccgaacggtaggaaggtacgaaacgaactacgtggctgcgaccactctgtcttctactcttcccgtcccact

SEQ ID NO: 601976 - DNA, 494 bp, Homo sapiens; identical to SEQ ID NO: 534992
  misc_feature: HIJSMM301BQ1LG.9.1.A01.1.454.light.4.raw

SEQ ID NO: 601977 - DNA, 503 bp, Homo sapiens; identical to SEQ ID NO: 557698
  misc_feature: HIJSMM301BB93Q.4.39.D06.1.454.light.4.raw

SEQ ID NO: 601978 - DNA, 512 bp, Homo sapiens
  misc_feature: HIJSMM301A01A6.40.47.E03.1.454.light.4.raw
tctagcgactcacgaccggtgctcgatttagactcgcgcacagagagaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccaataatgacgttggtggttacaactatgtctcctggtaccaacaatacccaggcaaagcccccaaactcctgatttatgaggtcagtaagcggccctcaggggtccctgatcgcttctctggctccaagtctgtcaacacggcctccctgaccgtctctgggctccaggctgaggatgaggctgtttactactgcagctcatatgcaggcagcaataatttggtgttcggcgggggaccaagctgaccgtcctaggtcagcccaaggctgccccctcggtccactctcg

SEQ ID NO: 601979 - DNA, 497 bp, Homo sapiens; identical to SEQ ID NO: 535740
  misc_feature: HIJSMM301C6DK6.3.71.G05.1.454.light.4.raw

SEQ ID NO: 601980 - DNA, 446 bp, Homo sapiens; identical to SEQ ID NO: 539491
  misc_feature: HIJSMM301DLW3H.18.9.A09.1.454.light.4.raw

SEQ ID NO: 601981 - DNA, 490 bp, Homo sapiens
  misc_feature: HIJSMM301DIHVK.14.55.E11.1.454.light.4.raw
cgtctagtaccacgaccggtgctcgatttagcactcgcacgttgggtttggggagtctcgagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtggctgcaccatctgtcttcta

SEQ ID NO: 601982 - DNA, 486 bp, Homo sapiens
  misc_feature: HIJSMM301C0OPM.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagactccctggctgtgtctctgggcgagcgggccaccatcaactgcaagtccagccacaatcttttatacagttccaacaatgaaaactacttatcttggtaccagcagagaccaggacagcctcctaggctgctcatttactgggcatctacccgggaatccggggtccctgaccgattcagtggcagcggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 601983 - DNA, 454 bp, Homo sapiens; identical to SEQ ID NO: 534964
  misc_feature: HIJSMM301EIF2D.19.86.H09.1.454.light.4.raw

SEQ ID NO: 601984 - DNA, 496 bp, Homo sapiens
  misc_feature: HIJSMM301B6R5S.27.78.H01.1.454.light.4.raw
agcgtcgtctcacgaccggtgctcgatttagtgtgagtagtttgggtttggggatgagcaaaactagacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttccaccctcaccatcaatagcctggaagctgaagatgctgcaacttattactgtcatcagagtactactttacctcaagtgatcaccttcggccaagggacacgactggagattaaacgaactgtggctgcaccatctgtctt

SEQ ID NO: 601985 - DNA, 493 bp, Homo sapiens
  misc_feature: HIJSMM301D2K4Y.52.26.C04.1.454.light.4.raw
cgcagtacgacacgaccggtgctcgatttagtctagcgactttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccaattggtacttatgtcttcggaactgcgaccaaggtcacgtcctgggtcagccaaggccaacccatgtcact

SEQ ID NO: 601986 - DNA, 478 bp, Homo sapiens; identical to SEQ ID NO: 535129
  misc_feature: HIJSMM301CUW4J.11.11.A11.1.454.light.4.raw

SEQ ID NO: 601987 - DNA, 524 bp, Homo sapiens
  misc_feature: HIJSMM301AYLNF.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaacggccaacccccactgtcactctgttcccgtccctccct

SEQ ID NO: 601988 - DNA, 532 bp, Homo sapiens
  misc_feature: HIJSMM301AIFY9.43.15.B04.1.454.light.4.raw
tgtgagtagtcacgaccggtgctcgatttagacagtatatatccgcgggggaggaactgctcagttaggacccagacggaaccatggaagccccagcgcagcttctcttcctcctgctactctggctcccagaaaccactggagaaatagtgatgacgcagtctccagccaccctgtctttgtctccaggggaaagagccaccctctcatgcagggccagtcagagtgttagcaccaacgtggcctggtaccagcagaaacctggccagcctccccggctcctcatctctggtgcatcctccagggccactggttccccagccaggttcagtggcagtgggtctgggacagagttcactctcaccatcagcagccttcagtctgaagattttgcagtttattactgtcaccagtatcataactggcctccaagggggactttcggtccgaacgggaccgaacggtaggaagttactaaccgaaaccgtacgtgggcgtgcaccaactctcgttcttctatcttcccgtcccc

SEQ ID NO: 601989 - DNA, 484 bp, Homo sapiens; identical to SEQ ID NO: 535211
  misc_feature: HIJSMM301CVK1W.47.46.E02.1.454.light.4.raw

SEQ ID NO: 601990 - DNA, 495 bp, Homo sapiens
  misc_feature: HIJSMM301BTR3Q.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatcttatttgggttctaatcgggcctccggggtccctgacaggttcagtggcagtggatcaggcacagattttacactagaaaatcagcagagtggaggctgaggatgttggggtttattactgcatgcaagctctacaaactccttactacttttggccaggggaccaagctggagatacaaacgaactgt

SEQ ID NO: 601991 - DNA, 497 bp, Homo sapiens
  misc_feature: HIJSMM301CZFDH.41.18.B07.1.454.light.4.raw
tctatactatcacgaccggtgctcgatttagtcgctgcgtaagggggggagcctagctgtggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcggggggaccaaggctgaccgtcctaggtcagcccaaggctcg

SEQ ID NO: 601992 - DNA, 509 bp, Homo sapiens
  misc_feature: HIJSMM301CNERR.21.22.B11.1.454.light.4.raw
  modified_base (467)..(467): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagccctccctgaccatcaggtgggctccggtccgaggatggaggctggactattactgtgcatccaacgggacgcaacatggggatgacaatctgagcggttgggngttcggcggagggaccaaactgaccgtcctaggtcagcccaa

SEQ ID NO: 601993 - DNA, 521 bp, Homo sapiens
  misc_feature: HIJSMM301CHNMX.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagccaaggctgccccctcggtccactctgtcccgtccct

SEQ ID NO: 601994 - DNA, 504 bp, Homo sapiens; identical to SEQ ID NO: 549053
  misc_feature: HIJSMM301BQ4P4.4.71.G05.1.454.light.4.raw

SEQ ID NO: 601995 - DNA, 495 bp, Homo sapiens; identical to SEQ ID NO: 543094
  misc_feature: HIJSMM301EK06L.22.57.F02.1.454.light.4.raw

SEQ ID NO: 601996 - DNA, 506 bp, Homo sapiens; identical to SEQ ID NO: 573372
  misc_feature: HIJSMM301D4MI9.19.78.H01.1.454.light.4.raw

SEQ ID NO: 601997 - DNA, 505 bp, Homo sapiens
  misc_feature: HIJSMM301DSHZE.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgagatgttgcagtttattactgtcaacatcgtaccgagtggcctccggggccacttcggccctgggccgaaggtggagatcaaacgaactgtggctgcaccatctgtcttcta

SEQ ID NO: 601998 - DNA, 495 bp, Homo sapiens
  misc_feature: HIJSMM301DMOWK.8.10.A10.1.454.light.4.raw
ctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaagagccaccctctcctgcagggccagtcttagtgttagcaacttagcctggtaccaacagaaacctggccaggctcccaggctcctcatctctgatacatccaacagggccactggcatcccagccaggttcagtggcagtgggtctgggacagacttcactctcaccatcagcagcctagagcctgaagattttgcactttattactgtcagcagcgtagtaactggcctttcactttcggccctgggaccaaagtggatatcaaacgaactgtggctgcacatctgtcttcatcttccgccat

SEQ ID NO: 601999 - DNA, 501 bp, Homo sapiens; identical to SEQ ID NO: 538461
  misc_feature: HIJSMM301AUSX9.13.11.A11.1.454.light.4.raw

SEQ ID NO: 602000 - DNA, 508 bp, Homo sapiens
  misc_feature: HIJSMM301AXIYB.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccgaaagctgaccgtcctaggtcagcccaaggctgcccccc

SEQ ID NO: 602001 - DNA, 485 bp, Homo sapiens
  misc_feature: HIJSMM301EHVNQ.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggccagggaccaagctggagatcaaacga

SEQ ID NO: 602002 - DNA, 481 bp, Homo sapiens
  misc_feature: HIJSMM301CRTA6.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccaaagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacacctgcgtggttttggctgttcggcgcggaccaag

SEQ ID NO: 602003 - DNA, 500 bp, Homo sapiens; identical to SEQ ID NO: 535310
  misc_feature: HIJSMM301DWIVH.47.66.F11.1.454.light.4.raw

SEQ ID NO: 602004 - DNA, 513 bp, Homo sapiens
  misc_feature: HIJSMM301ETSLW.16.83.H06.1.454.light.4.raw
tgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtgggggaaacggccttggacgtaaaagtgtgcactggtaccagcagaagccaggccaggcccctgtgctggtcgtctatgatgatagcgaccggccctcagggatccctgagcgattctctggctccaactctgggaacgcggccaccctgaccatcagcagggtcgaagccggggatgaggccgactattactgtcaggtgtgggatagtagtagtgatcattatgtcttcggatctgggaccagggtcaccgtcctaggtcagcccaaggcccaacccactgtcactctgttcccaccct

SEQ ID NO: 602005 - DNA, 521 bp, Homo sapiens
  misc_feature: HIJSMM301APAF5.10.29.C07.1.454.light.4.raw
catagtagtgcacgaccggtgctcgatttagagtgctacgaagggaaagggggggggtctcaggaggcagcgctctcgggacgtctccaccatggcctgggctctgctattcctcaccctcctcactcagggcacagggtcctgggcccgagtctgccctgactcagcctgcctccgtgtctgggtctcctggacagtcgatcaccatctcctgcactggaaccagcagtgacgttggtggttataactatgtctcctggtaccaacaacacccaggcaaagcccccaaacctcatgatttttgtatgtcagtaatcggccctcagggtttctaatcgcttctctggctccaagtctggcaacacggcctccctgaccatctctgggctccaggctgaggacgaggctgattattactgcagctcatatacaaccagcagcacttctgtattcggcgggagggaccaaagctcgaccgtacccgtaggtcgacgcccaaaggctcgcccccctccggttca

SEQ ID NO: 602006 - DNA, 493 bp, Homo sapiens
  misc_feature: HIJSMM301DEBG6.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgcagtttattactgtcagcagtataatgacttgggttttattctactttcggccctgggaccaagtggatttcagacgaactgtggctgcaccatctgtcttcta

SEQ ID NO: 602007 - DNA, 476 bp, Homo sapiens
  misc_feature: HIJSMM301BCD8J.48.51.E07.1.454.light.4.raw
agtatacatacacgaccggtgctcgatttagcatactctacaacacacaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtgggagacagagtcaccatcacttgccgggcaagtcagagcattagcagctatttaaattggtatcagcagaaaccagggaaagcccctaagctcctgatctatggtgcatccattttgcaaagtgggatcccatcagggttcagtggcagtgggtctgggacagatttcactctcaccatcagcagtttgcaacctgaagatttgcaacttactactgtcaacagagttacagtgacccgtacaattttggccaggggaccaagctggagatcaaacgaact

SEQ ID NO: 602008 - DNA, 496 bp, Homo sapiens
  misc_feature: HIJSMM301E2LEE.48.4.A04.1.454.light.4.raw
agtatacatacacgaccggtgctcgatttagagtagtgatcagggggagtcagtctcagtcaggacacagcatggacatgagggtccccgctcagctcctggggctcctgctactctggctccgaggtgccagatgtgacatccagatgacccagtctccatcatccctgtctgcatatgtgggggacagagtcaccatcacttgccgggcaagtcagagcattagtaggtatttaaattggtatcatcaaagaccagggatggcccctaacctcctgatctacggtacatccactttgcaaagtggggtcccctcaaggttcagcggcagtggctcttggacggatttcactctcaccatcaccagtcttcaggctgaagatttaggaattttactactgtcagcagacttacagtgttccgtacacttttggccaggggaccaaactggagatgaaacgaactgtggctgcaccatctgtcttcatcttccccg

SEQ ID NO: 602009 - DNA, 492 bp, Homo sapiens; identical to SEQ ID NO: 535126
  misc_feature: HIJSMM301EY3CZ.18.11.A11.1.454.light.4.raw

SEQ ID NO: 602010 - DNA, 495 bp, Homo sapiens; identical to SEQ ID NO: 538651
  misc_feature: HIJSMM301AGZ7X.10.79.H02.1.454.light.4.raw

SEQ ID NO: 602011 - DNA, 514 bp, Homo sapiens; identical to SEQ ID NO: 541418
  misc_feature: HIJSMM301C3VKU.17.33.C11.1.454.light.4.raw

SEQ ID NO: 602012 - DNA, 485 bp, Homo sapiens; identical to SEQ ID NO: 539423
  misc_feature: HIJSMM301CH00W.46.35.D02.1.454.light.4.raw

SEQ ID NO: 602013 - DNA, 494 bp, Homo sapiens
  misc_feature: HIJSMM301ANBZQ.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggacttttattactgtcagcagcgtgagttctggcctccgctcactttcggcggagggaccagggtggagatcaaacgaactgtggctgcaccatctgtcttcatt

SEQ ID NO: 602014 - DNA, 509 bp, Homo sapiens; identical to SEQ ID NO: 544573
  misc_feature: HIJSMM301B1DTX.10.88.H11.1.454.light.4.raw

SEQ ID NO: 602015 - DNA, 516 bp, Homo sapiens
  misc_feature: HIJSMM301BTZIN.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcgggacccagaccctggagcctcagttggaagcagccgatccagcctgcggagcctgtggggcaggtcagcccaaggctgccccctcggtcactctgttcccacctcctccacg

SEQ ID NO: 602016 - DNA, 493 bp, Homo sapiens; identical to SEQ ID NO: 541489
  misc_feature: HIJSMM301EH9M1.12.23.C01.1.454.light.4.raw

SEQ ID NO: 602017 - DNA, 479 bp, Homo sapiens
  misc_feature: HIJSMM301B8MT3.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcgccctggaccaatgtggatatcaaacgaactgtggctgcaccatctgt

SEQ ID NO: 602018 - DNA, 500 bp, Homo sapiens; identical to SEQ ID NO: 540012
  misc_feature: HIJSMM301C8P65.52.34.D01.1.454.light.4.raw

SEQ ID NO: 602019 - DNA, 434 bp, Homo sapiens; identical to SEQ ID NO: 535153
  misc_feature: HIJSMM301DS2KS.18.5.A05.1.454.light.4.raw

SEQ ID NO: 602020 - DNA, 491 bp, Homo sapiens; identical to SEQ ID NO: 536211
  misc_feature: HIJSMM301DG520.16.53.E09.1.454.light.4.raw

SEQ ID NO: 602021 - DNA, 503 bp, Homo sapiens
  misc_feature: HIJSMM301BMTXN.2.35.D02.1.454.light.4.raw
acgctcgacacacgaccggtgctcgatttagcacacgatagttggggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttactgaggtcactaagcggcccttaggggtccctgatcgcttctctggctccaagtctggcagaacggcctccctgaccgtctctgggcttccaagctgaggatgagggctgattattactgcagctcatatgcaggcagcagcaatgtacttttcggcgagggaccaagctgaccgtctgggtcagcccaaggctgcccctcggtc

SEQ ID NO: 602022 - DNA, 493 bp, Homo sapiens
  misc_feature: HIJSMM301DU7ZL.51.29.C07.1.454.light.4.raw
cgatcgtatacacgaccggtgctcgatttagagtgctacgaagggaaaggggggaactgctcagtcaggacccagacggaaccatggaagccccagcgcagcttctcttcctcctgctactctggctcccagatactactggagaaatagtgatgacgcagtctccagccacgctgtctgtgtctccaggggaaagagccaccctctcctgcagggccagtcagagtgttaacaacaacttagcctggtatcagcagaaacctggccaggctcccaggctcctcatctttggatcatccatcagggccactggtgtcccagaaaagttcagtggcggtgggtctgacacagagtacaccctcaccatcagcaccctgcagtctgaagatgtcgcagtttattactgtcaacaatatagtgacaggccgccatggacgttcggccaagggaccaaggtggaaatgaaggaactgtgctgcaccatctgtcttca

SEQ ID NO: 602023 - DNA, 499 bp, Homo sapiens; identical to SEQ ID NO: 572685
  misc_feature: HIJSMM301AK8Q7.15.25.C03.1.454.light.4.raw

SEQ ID NO: 602024 - DNA, 504 bp, Homo sapiens
  misc_feature: HIJSMM301A563M.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttggccaagggaccaaggttggaaatacaaacgaactagtggctgcaccatctgtcttcatcttccccg

SEQ ID NO: 602025 - DNA, 472 bp, Homo sapiens
  misc_feature: HIJSMM301A5BMY.49.82.H05.1.454.light.4.raw
agtcgagagacacgaccggtgctcgatttagtcgagctctctcgcgggcacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggataaatatgctggctggtatcagcagaagccaggccagtcccctgtgttggtcatctatcaagataccaagcggccctcagggatccctgagcgattctctggctccaactctgggaacacagccactctgaccatcagcgggactcaggctatcgatgaggctgactattactgtcaggcgtgggacagccgcactggggttacg

SEQ ID NO: 602026 - DNA, 445 bp, Homo sapiens; identical to SEQ ID NO: 537152
  misc_feature: HIJSMM301EYLX9.5.9.A09.1.454.light.4.raw

SEQ ID NO: 602027 - DNA, 516 bp, Homo sapiens
  misc_feature: HIJSMM301EB441.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctcgccccctcggtcactctcgttcccaccctcct

SEQ ID NO: 602028 - DNA, 384 bp, Homo sapiens; identical to SEQ ID NO: 555393
  misc_feature: HIJSMM301CIW5J.48.87.H10.1.454.light.4.raw

SEQ ID NO: 602029 - DNA, 505 bp, Homo sapiens
  misc_feature: HIJSMM301BQU30.41.45.E01.1.454.light.4.raw
tctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcgggcggggggaccaagctgaccgtcctaggtcagcccaaggctgccccctcggtccactcttcg

SEQ ID NO: 602030 - DNA, 514 bp, Homo sapiens; identical to SEQ ID NO: 544770
  misc_feature: HIJSMM301ADNEJ.16.66.F11.1.454.light.4.raw

SEQ ID NO: 602031 - DNA, 481 bp, Homo sapiens
  misc_feature: HIJSMM301C3NUE.41.68.G02.1.454.light.4.raw
tctatactatcacgaccggtgctcgatttagtcgatagtgaagggaaagggggcaggagtcagtcccaaccaggacacagcatggacatgagggtccctgctcagctcctggggctcctgctgctctggctctcaggtgccagatgtgacatccagatgacccagtctccaacctccctgtctgcatctgtaggagacagagtcaccatcacttgccaggccagtcaggacattagcaactatttaaattggtatcagcagaaaccagggaaagcccctaagctcctgatctacgatgcatccaatttggaatcagggtcccatcaaggttcagtggaagtggatctgggacagattttactttcaccatcaccagcctgcagcctgaagatattgcaacatattactgtcaacagtatgataatctccctcccactttcggcggaggaccaaggtggagatcaaacgaactgtggctgca

SEQ ID NO: 602032 - DNA, 503 bp, Homo sapiens; identical to SEQ ID NO: 538884
  misc_feature: HIJSMM301CCYG9.27.78.H01.1.454.light.4.raw

SEQ ID NO: 602033 - DNA, 489 bp, Homo sapiens; identical to SEQ ID NO: 553430
  misc_feature: HIJSMM301BGI3A.14.55.E11.1.454.light.4.raw

SEQ ID NO: 602034 - DNA, 485 bp, Homo sapiens; identical to SEQ ID NO: 538956
  misc_feature: HIJSMM301DM1MH.40.69.G03.1.454.light.4.raw

SEQ ID NO: 602035 - DNA, 496 bp, Homo sapiens; identical to SEQ ID NO: 566097
  misc_feature: HIJSMM301AQ49C.5.12.B01.1.454.light.4.raw

SEQ ID NO: 602036 - DNA, 488 bp, Homo sapiens; identical to SEQ ID NO: 539884
  misc_feature: HIJSMM301EZ66R.7.85.H08.1.454.light.4.raw

SEQ ID NO: 602037 - DNA, 486 bp, Homo sapiens; identical to SEQ ID NO: 548936
  misc_feature: HIJSMM301EGGNC.5.55.E11.1.454.light.4.raw

SEQ ID NO: 602038 - DNA, 490 bp, Homo sapiens
  misc_feature: HIJSMM301D60OK.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcggccaggggaccaaggtggaaggtcaagcgaactgtggctgcaccatctgtt

SEQ ID NO: 602039 - DNA, 489 bp, Homo sapiens
  misc_feature: HIJSMM301C7OAJ.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtggggctgaggatgttggcatttattactgcatgcaggctatacaccttcctgcctacttttggccaggggaccaagctggagatcaggcgtaacg

SEQ ID NO: 602040 - DNA, 463 bp, Homo sapiens; identical to SEQ ID NO: 535062
  misc_feature: HIJSMM301D5E7Z.11.73.G07.1.454.light.4.raw

SEQ ID NO: 602041 - DNA, 488 bp, Homo sapiens; identical to SEQ ID NO: 535861
  misc_feature: HIJSMM301B590A.14.55.E11.1.454.light.4.raw

SEQ ID NO: 602042 - DNA, 505 bp, Homo sapiens
  misc_feature: HIJSMM301CWBVJ.19.71.G05.1.454.light.4.raw
tactctcgtgcacgaccggtgctcgatttagtgtcgtcgcaagagagaggggggggtacaacaggcaggcaggggcgagcaagatggtgttgcagacccaggtcttcatttctctgttgctctggatctctggtgcccacggggacatcgtgatgacccagtctccagactccctggctgtgtctctgggcgagcggcaccatcaactgcaagtccagccacaatcttttatacagttccaacaatgaaaactacttagcttggtaccagcagagaccaggacagcctcctaggctgctcatttactgggcatctacccggggaatccggggtccctgaccgattcagtggcagcgggtctgggacagatttcactctcaccatcagcagcctgcaggctgaagatgtggcagtttattattgtcaacaattattattatacttcgtggacgttcggccgacgggaccgaaaggtggagtatcagacggaacctgtgggctgcaa

SEQ ID NO: 602043 - DNA, 499 bp, Homo sapiens; identical to SEQ ID NO: 555111
  misc_feature: HIJSMM301CT8LL.48.82.H05.1.454.light.4.raw

SEQ ID NO: 602044 - DNA, 490 bp, Homo sapiens; identical to SEQ ID NO: 535234
  misc_feature: HIJSMM301EYJF8.17.21.B10.1.454.light.4.raw

SEQ ID NO: 602045 - DNA, 511 bp, Homo sapiens; identical to SEQ ID NO: 537464
  misc_feature: HIJSMM301AMBXJ.7.34.D01.1.454.light.4.raw

SEQ ID NO: 602046 - DNA, 509 bp, Homo sapiens
  misc_feature: HIJSMM301AXK82.22.21.B10.1.454.light.4.raw
acatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcgggcctcaggggtccctgatcgcttctctggctccaagtctggcgacacggcctccctgaccgtctctgggctccaggctgaggatgaggctgattattactgctactcatatgcaggcggcaactcgttgggtgttcggcggagggaccaagctgaccgtcctaggtcagcccaaggctcgccccctcggtcactcttccg

SEQ ID NO: 602047 - DNA, 502 bp, Homo sapiens
  misc_feature: HIJSMM301BTQUT.49.82.H05.1.454.light.4.raw
agtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagcggccctcaggggtctctgatcgcttctctggctccacgtctggcagcacggcctccctgacaatctctgggctccaggctggggacgaggctgattattattgctgttcatatgccggtgatagtggccgaagggtgttcggcggagggaccaaggtgaccgtcctaggtcagccaaggctgccccctcggt

SEQ ID NO: 602048 - DNA, 493 bp, Homo sapiens; identical to SEQ ID NO: 540127
  misc_feature: HIJSMM301BCKAJ.10.17.B06.1.454.light.4.raw

SEQ ID NO: 602049 - DNA, 496 bp, Homo sapiens
  misc_feature: HIJSMM301BKO5C.22.57.F02.1.454.light.4.raw
acatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaacagcctgcagcctgatgatttggcaacttactactgccaaccgtatagtacttattcggtcaccttcggccaagggacacgaactggagattaaacgaactgtggctgcaccatctgtcttcatt

SEQ ID NO: 602050 - DNA, 497 bp, Homo sapiens; identical to SEQ ID NO: 535664
  misc_feature: HIJSMM301ARNL9.22.14.B03.1.454.light.4.raw

SEQ ID NO: 602051 - DNA, 473 bp, Homo sapiens; identical to SEQ ID NO: 536941
  misc_feature: HIJSMM301D8MAT.3.38.D05.1.454.light.4.raw

SEQ ID NO: 602052 - DNA, 495 bp, Homo sapiens; identical to SEQ ID NO: 535596
  misc_feature: HIJSMM301BRYJK.10.79.H02.1.454.light.4.raw

SEQ ID NO: 602053 - DNA, 479 bp, Homo sapiens; identical to SEQ ID NO: 538892
  misc_feature: HIJSMM301EO0Z4.22.59.F04.1.454.light.4.raw

SEQ ID NO: 602054 - DNA, 478 bp, Homo sapiens; identical to SEQ ID NO: 541928
  misc_feature: HIJSMM301CMPY8.7.76.G10.1.454.light.4.raw

SEQ ID NO: 602055 - DNA, 487 bp, Homo sapiens; identical to SEQ ID NO: 538190
  misc_feature: HIJSMM301BOECZ.47.70.G04.1.454.light.4.raw

SEQ ID NO: 602056 - DNA, 499 bp, Homo sapiens; identical to SEQ ID NO: 573830
  misc_feature: HIJSMM301C17P0.21.81.H04.1.454.light.4.raw

SEQ ID NO: 602057 - DNA, 502 bp, Homo sapiens
  misc_feature: HIJSMM301B7I6R.40.4.A04.1.454.light.4.raw
tctagcgactcacgaccggtgctcgatttagagtagtgatcagggggctacaacaggcaggcaggggcagcaagatggtgttgcagacccaggtcttcatttctctgttcctctggatctctggtgccttcggggacatcgtgatgacccagtctccagactccctggctctgtctctgggcgagagggccaccatcaactgcaagtccagccagagcgttttatccacttcctacaatcagaattacttagcttggtatcagcataaaccagggcagcctccgaggctgctcatttactggacatctatccgggaatccggggtccctgaccgattccgtggcaggtgggtctgggacagtattttactctcaccatcaccagccttcaggctgaagatgtggcagtttattactgtcaccaatatttagacattccctccgacgttcggccaagggaccaaggtggagatcaaacgaactgtggctgcaccatctgtctt

SEQ ID NO: 602058 - DNA, 489 bp, Homo sapiens; identical to SEQ ID NO: 544582
  misc_feature: HIJSMM301DO3GF.22.65.F10.1.454.light.4.raw

SEQ ID NO: 602059 - DNA, 506 bp, Homo sapiens
  misc_feature: HIJSMM301B67AP.10.79.H02.1.454.light.4.raw
catagtagtgcacgaccggtgctcgatttagtgtcacacgaagggaaagggggagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggactttggtcgacgggaccggacgactggaggatacaaacgaaactagtggtcgtgcgaccactctgtcttcta

SEQ ID NO: 602060 - DNA, 502 bp, Homo sapiens; identical to SEQ ID NO: 543936
  misc_feature: HIJSMM301BQF57.15.1.A01.1.454.light.4.raw

SEQ ID NO: 602061 - DNA, 503 bp, Homo sapiens; identical to SEQ ID NO: 535140
  misc_feature: HIJSMM301E0QSK.18.37.D04.1.454.light.4.raw

SEQ ID NO: 602062 - DNA, 496 bp, Homo sapiens
  misc_feature: HIJSMM301C9921.51.5.A05.1.454.light.4.raw
cgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaaatctgctttttggtaccatcagaggccaggccaggcccctgtattggtcatctatgaggacaccaagcgaccctccggaatccctgagagagtcgctggctccaggtcagggacaatggccaccttgactatcactgggacccagatggacgatgaaggtgactaccactgttattcgacagacagcagtggtagtcagggggtcttcgggcggagggacgaagctgaccgtcctgagtcagcccaaggctgccccctcggtcact

SEQ ID NO: 602063 - DNA, 508 bp, Homo sapiens; identical to SEQ ID NO: 588546
  misc_feature: HIJSMM301AZYVX.40.48.E04.1.454.light.4.raw

SEQ ID NO: 602064 - DNA, 486 bp, Homo sapiens; identical to SEQ ID NO: 535917
  misc_feature: HIJSMM301BTYU2.3.10.A10.1.454.light.4.raw

SEQ ID NO: 602065 - DNA, 492 bp, Homo sapiens
  misc_feature: HIJSMM301EWFCV.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaactgtaggctgcaccatctgtcttcatt

SEQ ID NO: 602066 - DNA, 496 bp, Homo sapiens
  misc_feature: HIJSMM301EATII.27.78.H01.1.454.light.4.raw
  modified_base (427)..(427): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttccaccctcaccatcaatagcctggaagctgaagatgctgcaacttattactgtcatcagagtactactttaccncaagtgatcaccttcggccaagggaccacgactggagattaaacgaactgtggctgcaccatctgtctt

SEQ ID NO: 602067 - DNA, 517 bp, Homo sapiens
  misc_feature: HIJSMM301DHYOP.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccaagggaccgaaggtacggaaggtacgaaacgaacgtagtaggctgcaccactctgtcttcatcttcccgcctact

SEQ ID NO: 602068 - DNA, 505 bp, Homo sapiens
  misc_feature: HIJSMM301DRNA6.10.71.G05.1.454.light.4.raw
catagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccgaaaatagaggtacaaacgaactagtggctgcaccatctgtcttcatt

SEQ ID NO: 602069 - DNA, 508 bp, Homo sapiens; identical to SEQ ID NO: 552440
  misc_feature: HIJSMM301DE5IY.5.24.C02.1.454.light.4.raw

SEQ ID NO: 602070 - DNA, 498 bp, Homo sapiens
  misc_feature: HIJSMM301CUR19.22.86.H09.1.454.light.4.raw
acatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggcctgccccctggtccactctgttccccaccctcct

SEQ ID NO: 602071 - DNA, 489 bp, Homo sapiens
  misc_feature: HIJSMM301ED15W.52.85.H08.1.454.light.4.raw
cgcagtacgacacgaccggtgctcgatttagtatcactcagtcgcgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaattatttaaattggtatcagcagaaaccagggaaagcccctaaactcctgatctacgatgcatccaatttggaaacaggggtcccatcaaggttcagtggaagtggttctgggacacattttactttcaccatcagcggcctgcagcctgaagatattgcaacatattactgtcaacagtaatggtaatcttcccactcactttcggcggagggaccaaggtcgagatcaaacgaactgtggctgcaccatctgtctt

SEQ ID NO: 602072 - DNA, 494 bp, Homo sapiens
  misc_feature: HIJSMM301DMMGM.51.35.D02.1.454.light.4.raw
cgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctggtcagcccaaggccaacccactgtcact

SEQ ID NO: 602073 - DNA, 504 bp, Homo sapiens
  misc_feature: HIJSMM301EPBGT.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggcccgggaccaaagtggaaatcaaacgaactgtggctgcaccatctgtcttcatctccgcc

SEQ ID NO: 602074 - DNA, 487 bp, Homo sapiens
  misc_feature: HIJSMM301DASWJ.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtgggatatcagacgaa

SEQ ID NO: 602075 - DNA, 499 bp, Homo sapiens
  misc_feature: HIJSMM301CT1U4.47.66.F11.1.454.light.4.raw
agctcacgtacacgaccggtgctcgatttagtcacgcgagaagggggaggaactgctcagttaggacccagagggaaccatggaagccccagctcagcttctcttcctcctgctactctggctcccagaaatcgccggagacattctattgacacaggctccagtcaccctgtctttgtctccaggggaaagagccaccctctcctgcagggccagtcaaagcatcggcaacaatttggcctggtatcaacagaaacctggccaggctcccaggctcctcatctacgatgcatccaacagggccactggcgtcccaggcaggttcagaggcggtgggtctgggacagacttcactctcaccattgacggcctagagcctgaagattttgcagtttattactgtcagcagcgtaacaattggccgatcaccttcggccaagggacacgactggagattaaacgaactgtgctgcaccatctgtcttcatcttcccgccat

SEQ ID NO: 602076 - DNA, 483 bp, Homo sapiens
  misc_feature: HIJSMM301C0QZL.3.10.A10.1.454.light.4.raw
agacgcactccacgaccggtgctcgatttagcgtcgatctcagggggctggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagttgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcacgtctagtcagccaaggccaa

SEQ ID NO: 602077 - DNA, 495 bp, Homo sapiens; identical to SEQ ID NO: 574296
  misc_feature: HIJSMM301BCYVX.15.71.G05.1.454.light.4.raw

SEQ ID NO: 602078 - DNA, 504 bp, Homo sapiens; identical to SEQ ID NO: 563936
  misc_feature: HIJSMM301EJ7FB.18.59.F04.1.454.light.4.raw

SEQ ID NO: 602079 - DNA, 485 bp, Homo sapiens; identical to SEQ ID NO: 573100
  misc_feature: HIJSMM301DJSSK.49.35.D02.1.454.light.4.raw

SEQ ID NO: 602080 - DNA, 500 bp, Homo sapiens
  misc_feature: HIJSMM301A220K.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccgaccctcccctccacgagtacgtacgtgcgggccgggtcggtcggacggacggccgacgtaagta

SEQ ID NO: 602081 - DNA, 474 bp, Homo sapiens
  misc_feature: HIJSMM301CPQ4Z.15.81.H04.1.454.light.4.raw
tctacgtagccacgaccggtgctcgatttagtagtgtagattcgcggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgccccctcggtcactctgttcccgccctcctcgctacgtaga

SEQ ID NO: 602082 - DNA, 495 bp, Homo sapiens
  misc_feature: HIJSMM301DZS04.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacaagaaaccagggaaagcccctgacctcctgatctatgctgcatccagtttgcacaggtggggtcccgtcaaggttcagtggcagtggatctgggacagatttcactctcaccgtcagcagtctgcaacctgaagtattttgcaacttactactgtcaacagagttacacgtacccccctcacctttcggcggagggaccaagggtggagatcagacgaactgtggctgcaccatctgtcttcta

SEQ ID NO: 602083 - DNA, 487 bp, Homo sapiens
  misc_feature: HIJSMM301CTJFF.10.53.E09.1.454.light.4.raw
  modified_base (406)..(406): a, c, t, g, unknown or other
catagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttattcagctccgacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagntgcggcagtttatactgtcagcactattatacgtaccccattcacattccggccctggaccaaagtggagatacaaacgaa

SEQ ID NO: 602084 - DNA, 483 bp, Homo sapiens
  misc_feature: HIJSMM301DH0RM.12.10.A10.1.454.light.4.raw
atacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaaagcccctaacgtcctgatctatggtgcatccactttgcatagtggggtcccatcaaggttcagcggcagtggatctgggacagaattcactctcacaatcaccagcctgcagcctgaagtattttgctaacttattactgtcaactaggtttatatttaccctgttattttcggccctgggaccacagtagatatacaaacgaactgtggctgcacc

SEQ ID NO: 602085 - DNA, 493 bp, Homo sapiens; identical to SEQ ID NO: 537912
  misc_feature: HIJSMM301A9M91.13.46.E02.1.454.light.4.raw

SEQ ID NO: 602086 - DNA, 495 bp, Homo sapiens
  misc_feature: HIJSMM301CTVYF.43.35.D02.1.454.light.4.raw
tgtgagtagtcacgaccggtgctcgatttagcacacgatagttgggtttgggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaaagtggggtcccattaaggttcagcggcagtggatctgggacagagtttactctcaccatcagcagcctgcagcctgatgattttgcaacttattactgccaacaatatgattcttggccgtggacgttcggccaagggaccaacgtggaaatcaaacgaactgtggctgcaccatctgtcttcatt

SEQ ID NO: 602087 - DNA, 454 bp, Homo sapiens; identical to SEQ ID NO: 536347
  misc_feature: HIJSMM301D5LJZ.19.86.H09.1.454.light.4.raw

SEQ ID NO: 602088 - DNA, 491 bp, Homo sapiens; identical to SEQ ID NO: 535176
  misc_feature: HIJSMM301BOCFG.13.39.D06.1.454.light.4.raw

SEQ ID NO: 602089 - DNA, 522 bp, Homo sapiens
  misc_feature: HIJSMM301B3UHM.27.23.C01.1.454.light.4.raw
agcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccaccct

SEQ ID NO: 602090 - DNA, 441 bp, Homo sapiens; identical to SEQ ID NO: 535074
  misc_feature: HIJSMM301C6654.11.3.A03.1.454.light.4.raw

SEQ ID NO: 602091 - DNA, 502 bp, Homo sapiens
  misc_feature: HIJSMM301C2GRG.9.53.E09.1.454.light.4.raw
tgatacgtctcacgaccggtgctcgatttagagagagtgtgttgggtttgggggggtcacaagaggaagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattatactgctgctcatatgcagatggtgacactcccgtggtattcggcggagggaccaaggtgaccgtcctaggtcagcccaaggctgccccctc

SEQ ID NO: 602092 - DNA, 487 bp, Homo sapiens; identical to SEQ ID NO: 535583
  misc_feature: HIJSMM301AJ10J.22.73.G07.1.454.light.4.raw

SEQ ID NO: 602093 - DNA, 499 bp, Homo sapiens
  misc_feature: HIJSMM301ESCXZ.9.71.G05.1.454.light.4.raw
tgatacgtctcacgaccggtgctcgatttagtgtcgtcgcaagagagagggggggggtcacaagaggcagcgactctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctcttttcaagatattcggcggagggaccaggctgaccgtcctgagtcagcccaaggctg

SEQ ID NO: 602094 - DNA, 487 bp, Homo sapiens; identical to SEQ ID NO: 539157
  misc_feature: HIJSMM301C7OGA.26.37.D04.1.454.light.4.raw

SEQ ID NO: 602095 - DNA, 486 bp, Homo sapiens; identical to SEQ ID NO: 535043
  misc_feature: HIJSMM301DPA6E.46.35.D02.1.454.light.4.raw

SEQ ID NO: 602096 - DNA, 497 bp, Homo sapiens
  misc_feature: HIJSMM301AKEP6.21.15.B04.1.454.light.4.raw
tcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgaaagggccaccatcaactgcaagtccagcccgagtgtcttatcctcctccgacaataagaactacttagcttggtaccagcagcaaccaggacaacgtcctaaattgctcatttactgggcatctgtccgggaatccggggtccctgaccgattcgttggcagcgggtctgggacagatttcactctcaccatcagcagcctacaggctgaagatgtggcagttattttgtatgcaacattatgccgctccgctcactttcggcggagggaccaaggtggaggatcaaacgaactgtggctgcaccat

SEQ ID NO: 602097 - DNA, 491 bp, Homo sapiens
  misc_feature: HIJSMM301AHMP7.16.72.G06.1.454.light.4.raw
tgtactactccacgaccggtgctcgatttagctacgactgcaagggaaagggggaggaactgctcagttaggacccagacggaaccatggaagccccagcgcagcttctcttcctcctgctactctggctcccagatacctctggagaaacagtgatgacgcagtctccagccaccctctctgtgtctccaggggaaagagtcaccctctcctgcagggccagtcagagtgttagcagcaacttagcctggtatcagcagaaacctggccaggctcccaggctcctcatctatgatgcatccaccagggccactggtatcccagccaggttcagtggcagtgggtttgggacagagttcactctcaccatcagcagcctgcagtctgaagattttgctagtttattactgtcagcagtataataactggcctccggtcactttcggcggagggaccgaaggtggagatcaaacgaactgtggctgcaccat

SEQ ID NO: 602098 - DNA, 503 bp, Homo sapiens
  misc_feature: HIJSMM301C2V50.2.76.G10.1.454.light.4.raw
acgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtccccgggcagagggtcaccatctcttgttctggaggcacctccaacatcgggcgtgataatgtgtactggtacaagcaggtcccaggaacgacccccaaactcctcatctctcacaataatcagcggccctcaggagtccctgaccgattctctgcctccaagtccggcacctcagcctccctggccatcagtgggctccgggccgaggatgaggctgattattactgtgcaggatggggatggacaacctgggtgcttatctcttcggacctggaccaaggtcaccgtccttggt

SEQ ID NO: 602099 - DNA, 502 bp, Homo sapiens; identical to SEQ ID NO: 538897
  misc_feature: HIJSMM301E0ZKP.21.38.D05.1.454.light.4.raw

SEQ ID NO: 602100 - DNA, 492 bp, Homo sapiens
  misc_feature: HIJSMM301CYZZX.15.3.A03.1.454.light.4.raw
tctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtatcagaaaaaccaggacagcctcctaagctgctcatttactgggcatctacccgggaatccggggtccctgaccgattcagtggcagcgggtctggcacagatttcactctcaccatcagcagcctgcaggctgaagatgtggcagtttattactgtcagcaatatagaaagtattccttttactttcggccctgggaccaaagtggatatcaaacgaactgtggctgcaccat

SEQ ID NO: 602101 - DNA, 517 bp, Homo sapiens
  misc_feature: HIJSMM301EI0DS.12.85.H08.1.454.light.4.raw
atacgacgtacacgaccggtgctcgatttagtatcactcagtcgcggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttggtcgttataactttgtctcctggtacaaacagcacccaggcaaagccccccaactcctgatttatgaggtcactattcggtcctcaggaatttctaatcgcttctctggttccaagtctggcaacacggcctccctgaccatctctggggtccaggctgaggacgaggctgattattacttgcagttcatatacaagcacttccactctcgtggtgttcggcggtgggaccaagctgaccgtcctaagtcagcccaaggctgccccctcggtcactctgttcccg

SEQ ID NO: 602102 - DNA, 480 bp, Homo sapiens
  misc_feature: HIJSMM301CARR8.48.67.G01.1.454.light.4.raw
agtatacatacacgaccggtgctcgatttagagtatacatattgggtttggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagaccccg

SEQ ID NO: 602103 - DNA, 498 bp, Homo sapiens; identical to SEQ ID NO: 537020
  misc_feature: HIJSMM301BDW30.26.26.C04.1.454.light.4.raw

SEQ ID NO: 602104 - DNA, 510 bp, Homo sapiens
  misc_feature: HIJSMM301CH1EN.10.75.G09.1.454.light.4.raw
catagtagtgcacgaccggtgctcgatttagtatagacatcaggggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaagtgacattggttctttaaattttgtctcttggtaccaacagagcccagacaaagcccccaaaattatcatttctgctgtcagtaatcggccctcaggggtttctagtcgcttctctggctccaagtctggcaacacggcctccctgaccatctctgggctccaggctgaggacgaggctgattattattgcagctcatatacaaacaccaaagctttgatattcggcggagggaccaaactgaccgtccttcgtcagccaaggctgcccctccggtcactctgttcccgt

SEQ ID NO: 602105 - DNA, 498 bp, Homo sapiens
  misc_feature: HIJSMM301CKHER.2.34.D01.1.454.light.4.raw
acgctcgacacacgaccggtgctcgatttagatcgtctgtgttgggtttgggggctttgcctgggctctgctcctcctcaccctcctcactcagggcacagggtcctgggcccagtctgccctgactcagcccccctccgcgtccgggtctcctggacagtcagtcaccatctcctgcactggaatcagcagtgacctgagtccttataactatgtctcctggtaccaacaacacccaggcaaagcccccaaactcattatttatgaagtcactaagcggccctcaggggtccctgatcgcttctctggctccaagtctggcgagacggcctccctgaccgtctctgggctccaggctgaagatgaggctgattattactgcagctcatatgcaggcagcaacaatgtggcattcggcggagggaccaagctgaccgtcctgggtcagcccaaggctgccccctggtcactctcgttcccaccctctctgtcgagcgt

SEQ ID NO: 602106 - DNA, 520 bp, Homo sapiens; identical to SEQ ID NO: 595030
  misc_feature: HIJSMM301A4TPN.22.30.C08.1.454.light.4.raw

SEQ ID NO: 602107 - DNA, 384 bp, Homo sapiens; identical to SEQ ID NO: 573462
  misc_feature: HIJSMM301CCZ0X.48.33.C11.1.454.light.4.raw

SEQ ID NO: 602108 - DNA, 485 bp, Homo sapiens; identical to SEQ ID NO: 536075
  misc_feature: HIJSMM301DLAX8.17.21.B10.1.454.light.4.raw

SEQ ID NO: 602109 - DNA, 488 bp, Homo sapiens; identical to SEQ ID NO: 537260
  misc_feature: HIJSMM301BPC3T.47.70.G04.1.454.light.4.raw

SEQ ID NO: 602110 - DNA, 504 bp, Homo sapiens; identical to SEQ ID NO: 538423
  misc_feature: HIJSMM301CB50I.48.67.G01.1.454.light.4.raw

SEQ ID NO: 602111 - DNA, 482 bp, Homo sapiens
  misc_feature: HIJSMM301BYDKV.49.53.E09.1.454.light.4.raw
agtcgagagacacgaccggtgctcgatttagagagagtgtgttgggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccgggtccctgagcgattcagtggcagcgggtctgggacagatttcactctcaccatcagcagcctgcagactgaagatgtggcagtgtattactgtcagcaatatcacactgctccgctcactttcggcggaggaccgaggtggagatcaaacg

SEQ ID NO: 602112 - DNA, 508 bp, Homo sapiens
  misc_feature: HIJSMM301BN0A9.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtggaaatacaaacgaactacgtggctgcaccactctgtcttctactcttccccg

SEQ ID NO: 602113 - DNA, 487 bp, Homo sapiens
  misc_feature: HIJSMM301CIQ0S.49.57.F02.1.454.light.4.raw
agtcgagagacacgaccggtgctcgatttagctcgatatagttgggtttgggggctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccagggtggagatcaaacgtaacg

SEQ ID NO: 602114 - DNA, 445 bp, Homo sapiens; identical to SEQ ID NO: 542143
  misc_feature: HIJSMM301DFSRA.47.85.H08.1.454.light.4.raw

SEQ ID NO: 602115 - DNA, 522 bp, Homo sapiens
  misc_feature: HIJSMM301D0T0T.49.9.A09.1.454.light.4.raw
agtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcagggatccctgagcgattttctggctccaagtctgggaacacggccaccctgaccgtcagcagggtcgaagccggggatgaggccgactatatctgtcaggtgtgggatagtagtagtgctcttccgggggtgttcggcggagggaccaaggttgaccgtcgttggtcagcccaaggctgccccctggtcactctgttcccgccctcctctctctcga

SEQ ID NO: 602116 - DNA, 494 bp, Homo sapiens
  misc_feature: HIJSMM301BHR1D.27.78.H01.1.454.light.4.raw
agcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgccgcaacttattactgtcatcagagtactactttacctcaagtgatcaccttcggccaagggacacgactggagattaacgaactgtggctgcacatctgtctt

SEQ ID NO: 602117 - DNA, 489 bp, Homo sapiens; identical to SEQ ID NO: 535139
  misc_feature: HIJSMM301DDR0A.14.55.E11.1.454.light.4.raw

SEQ ID NO: 602118 - DNA, 483 bp, Homo sapiens
  misc_feature: HIJSMM301BIFJU.51.41.D08.1.454.light.4.raw
cgatcgtatacacgaccggtgctcgatttagtcacgcgagaaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaaactcctgatctatgctgcatccagtttgcaaagtgaggtcccatccaggttcagtggcagtggatctgggacagatttcactctcaccatcagtagtctgcaacctgaagattttgcaacttactactgtcaacagagttacggtaccctgctcactttcggcggagggaccaaggtggagatcaaacgaactagtggctgcacc

SEQ ID NO: 602119 - DNA, 519 bp, Homo sapiens
  misc_feature: HIJSMM301C5CTY.10.38.D05.1.454.light.4.raw
  modified_base (467)..(467): a, c, t, g, unknown or other
catagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttgggcggcgggactaagggtnaccgtcctgggtcagcccaaggctgccccctcggtccactctgttcccacct

SEQ ID NO: 602120 - DNA, 507 bp, Homo sapiens; identical to SEQ ID NO: 572988
  misc_feature: HIJSMM301DUJE9.47.55.E11.1.454.light.4.raw

SEQ ID NO: 602121 - DNA, 492 bp, Homo sapiens
  misc_feature: HIJSMM301DB2FO.51.81.H04.1.454.light.4.raw
  modified_base (231)..(231): a, c, t, g, unknown or other
cgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattatgtcaatcaacagacaccattggacttatgtcttcggaactgcgaccaaggtcaccgtcctggtcagcccaaggccaacccactgtcactctcg

SEQ ID NO: 602122 - DNA, 509 bp, Homo sapiens
  misc_feature: HIJSMM301B05YJ.17.28.C06.1.454.light.4.raw
cgtagactagcacgaccggtgctcgatttagagctcacgtattgggtttgggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgccccccg

SEQ ID NO: 602123 - DNA, 485 bp, Homo sapiens; identical to SEQ ID NO: 553490
  misc_feature: HIJSMM301BBAYT.46.35.D02.1.454.light.4.raw

SEQ ID NO: 602124 - DNA, 481 bp, Homo sapiens
  misc_feature: HIJSMM301BLDJK.48.34.D01.1.454.light.4.raw
agtatacatacacgaccggtgctcgatttagatcgtctgtgttgggtttggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccgaagctgaccgtcctaagtcagaccccg

SEQ ID NO: 602125 - DNA, 508 bp, Homo sapiens; identical to SEQ ID NO: 535835
  misc_feature: HIJSMM301A0Q6A.8.34.D01.1.454.light.4.raw

SEQ ID NO: 602126 - DNA, 489 bp, Homo sapiens
  misc_feature: HIJSMM301BIW4H.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtgggtcccatcaaggttcagcggcagtgggtctgggacagaattcactctcaccatcagcagcctgcaacctgatgactttgcaacttattactgccaacagtataatggttatgaatccacttttggccaagggaccaagctggagatcaaacgaactgtggctgcaccta

SEQ ID NO: 602127 - DNA, 520 bp, Homo sapiens; identical to SEQ ID NO: 539176
  misc_feature: HIJSMM301EA63I.27.23.C01.1.454.light.4.raw

SEQ ID NO: 602128 - DNA, 512 bp, Homo sapiens
  misc_feature: HIJSMM301DBJ2C.43.19.B08.1.454.light.4.raw
tgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctcggtcactctgtcccaccctctccta

SEQ ID NO: 602129 - DNA, 496 bp, Homo sapiens
  misc_feature: HIJSMM301BPQCT.18.11.A11.1.454.light.4.raw
tacgagtatgcacgaccggtgctcgatttagctacgactgcagggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaattactatagtcctcctctcacgttcggcggaggaccaaggtggagatcaaacgaactgtggctgcaccatctgtcttcatctcccgcatctgac

SEQ ID NO: 602130 - DNA, 489 bp, Homo sapiens
  misc_feature: HIJSMM301BBB5M.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggaggaccgaaggcggagatcagacgaactgtggctgcaccatctgtcttcta

SEQ ID NO: 602131 - DNA, 498 bp, Homo sapiens
  misc_feature: HIJSMM301C0GP7.7.5.A05.1.454.light.4.raw
cgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccaatcgcttctctggctccaagtctggcgacacggcctccctcgaccatctctgggctccaggctgaagacgaggctgattattactgcagctcatatacaggcagcagcactcaggttttcggcggagggaccaagctgaccgtcctaggtcagcccaaggctcgccccctcggt

SEQ ID NO: 602132 - DNA, 486 bp, Homo sapiens; identical to SEQ ID NO: 535043
  misc_feature: HIJSMM301DSVZU.46.35.D02.1.454.light.4.raw

SEQ ID NO: 602133 - DNA, 503 bp, Homo sapiens
  misc_feature: HIJSMM301A9JDO.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccgacgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtcctgggtcagcccaaggctgccccctggtcta

SEQ ID NO: 602134 - DNA, 497 bp, Homo sapiens; identical to SEQ ID NO: 536371
  misc_feature: HIJSMM301D50NO.16.78.H01.1.454.light.4.raw

SEQ ID NO: 602135 - DNA, 504 bp, Homo sapiens; identical to SEQ ID NO: 549053
  misc_feature: HIJSMM301EP7S2.4.71.G05.1.454.light.4.raw

SEQ ID NO: 602136 - DNA, 485 bp, Homo sapiens; identical to SEQ ID NO: 536040
  misc_feature: HIJSMM301DQULL.15.1.A01.1.454.light.4.raw

SEQ ID NO: 602137 - DNA, 521 bp, Homo sapiens; identical to SEQ ID NO: 538715
  misc_feature: HIJSMM301EIP33.27.23.C01.1.454.light.4.raw

SEQ ID NO: 602138 - DNA, 504 bp, Homo sapiens
  misc_feature: HIJSMM301BV7ZW.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcttcggccaagggaccaaggtggaaaagtcaaacgaactagtggctgcaccatctgtcttcatcttccccg

SEQ ID NO: 602139 - DNA, 502 bp, Homo sapiens; identical to SEQ ID NO: 539314
  misc_feature: HIJSMM301DZEX0.21.81.H04.1.454.light.4.raw

SEQ ID NO: 602140 - DNA, 492 bp, Homo sapiens; identical to SEQ ID NO: 583784
  misc_feature: HIJSMM301DEQHP.14.28.C06.1.454.light.4.raw

SEQ ID NO: 602141 - DNA, 475 bp, Homo sapiens
  misc_feature: HIJSMM301DDJJP.53.72.G06.1.454.light.4.raw
cgcgtatacacacgaccggtgctcgatttagctacgactgcaagggaaaggggctgggcctcaggaagcagcatcggaggtgcctcagccatggcatggatccctctcttcctcggcgtccttgcttactgcacaggatgcgtggcctcctatgagctgactcagccaccctcagtgtccgtgtccccaggacagacagccagcatcacctgctctggagacaagttgggggataaatatgctggctggtatcagcagaagccaggccagtcccctgtgttagtcatctatcaagatacaaagcggccctcagggatccctgagcgattctctggctccaactctgggaacacagccactctgaccatcagcgggactcaggctatcgatgaggctgactattactgtcaggcgtgggacagccgcactgggtgttcggcggagggaccaagctgaccgtcctgagtcagccccg

SEQ ID NO: 602142 - DNA, 494 bp, Homo sapiens; identical to SEQ ID NO: 535276
  misc_feature: HIJSMM301CHUB7.16.6.A06.1.454.light.4.raw

SEQ ID NO: 602143 - DNA, 487 bp, Homo sapiens; identical to SEQ ID NO: 554782
  misc_feature: HIJSMM301BP4MP.46.35.D02.1.454.light.4.raw

SEQ ID NO: 602144 - DNA, 502 bp, Homo sapiens; identical to SEQ ID NO: 573679
  misc_feature: HIJSMM301BWO03.7.71.G05.1.454.light.4.raw

SEQ ID NO: 602145 - DNA, 523 bp, Homo sapiens
  misc_feature: HIJSMM301BJ9BF.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggccggagggaccaggctgaccgtcctaggtcagcccaaggctgccccctcggtcactctgttcccaccctt

SEQ ID NO: 602146 - DNA, 492 bp, Homo sapiens; identical to SEQ ID NO: 537933
  misc_feature: HIJSMM301A0EBC.48.71.G05.1.454.light.4.raw

SEQ ID NO: 602147 - DNA, 502 bp, Homo sapiens; identical to SEQ ID NO: 537363
  misc_feature: HIJSMM301C1H5K.18.23.C01.1.454.light.4.raw

SEQ ID NO: 602148 - DNA, 495 bp, Homo sapiens
  misc_feature: HIJSMM301CMEGO.9.67.G01.1.454.light.4.raw
tgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccactggtatcccggccaggttcagtggtagtgggtctgggacagagttcgttctcaccatcagcagcctgcagtctgaagattttgcagtttattactgtcagcactataatagttgccgctcactttcggcggagggaccaaggtggagctcaaacgaactgtggctgcaccatctgtcttcat

SEQ ID NO: 602149 - DNA, 486 bp, Homo sapiens; identical to SEQ ID NO: 535385
  misc_feature: HIJSMM301D1U45.19.71.G05.1.454.light.4.raw

SEQ ID NO: 602150 - DNA, 490 bp, Homo sapiens
  misc_feature: HIJSMM301CDU9U.41.21.B10.1.454.light.4.raw
tctatactatcacgaccggtgctcgatttagtgtcgtcgcaagggggagccctggggaggaactgctcagttaggacccagagggaaccatggaagccccagctcagcttctcttcctcctgctactctggctcccagataccaccggacaaattgtgttgacacagtctccagccaccctgtctttgtctccaggggaaagagccaccctctcctgcagggccagtcagagtgttagcaaccacttagcctggtaccaacagagacctggccagactcccagactcgtcatctatgatgcatccaagagggccactggcatcccagccaggttcagtggcagtgggtctgggacagacttcactctcaccatcagcagcctagagcctgaagattttgcagtttattactgtcagcagcgtggcgactggcctcgcatcaccttcggccaagggacacgactggagactagacgaactgtggctgcacc

SEQ ID NO: 602151 - DNA, 489 bp, Homo sapiens; identical to SEQ ID NO: 535139
  misc_feature: HIJSMM301DWGJ5.14.55.E11.1.454.light.4.raw

SEQ ID NO: 602152 - DNA, 480 bp, Homo sapiens
  misc_feature: HIJSMM301CKJ7Z.12.10.A10.1.454.light.4.raw
atacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaaagcccctaacgtcctgatctatggtgcatccactttgcatagtggggtcccatcaaggttcagcggcagtggatctgggacagaattcactctcacaatcaccagcctgcagcctgaagattttgcaacttattactgtcaacaggtttatatttaccctcgtattttcggcccttgggaccacacgtagatatcaaacgaactgtggctgcac

SEQ ID NO: 602153 - DNA, 444 bp, Homo sapiens; identical to SEQ ID NO: 540477
  misc_feature: HIJSMM301BP85C.17.21.B10.1.454.light.4.raw

SEQ ID NO: 602154 - DNA, 504 bp, Homo sapiens
  misc_feature: HIJSMM301DB61N.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtaggaaatcaaacgaactagtggctgcaccatctgtcttcatcttccccg

SEQ ID NO: 602155 - DNA, 487 bp, Homo sapiens; identical to SEQ ID NO: 554782
  misc_feature: HIJSMM301C56GU.46.35.D02.1.454.light.4.raw

SEQ ID NO: 602156 - DNA, 511 bp, Homo sapiens
  misc_feature: HIJSMM301AIA85.15.34.D01.1.454.light.4.raw
tctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacggggcccaggcagacgatgaatgtgattatcactgcgtcctttatgtggggcgtggcatttgggtgttcggcggagggaccaaaactgaccgtcctaggtcagcccaaggctgccccctcggtcactctgttcccgccctcctcgctacgtaga

SEQ ID NO: 602157 - DNA, 460 bp, Homo sapiens
  misc_feature: HIJSMM301EYE3P.49.84.H07.1.454.light.4.raw
agtcgagagacacgaccggtgctcgatttagcagacgtctgtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggataaatatgctggctggtatcagcagaagccaggccagtcccctgtgttggtcatctatcaagataccaagcggccctcagggatccctgagcgattctctggctccaactctgggaacacagccactctgaccatcagcgggactcaggctatcgatgaggctgacttattactgtcaggcggtgggacagccgcactggggtattcgggcggagggaccaagctgaccgt

SEQ ID NO: 602158 - DNA, 491 bp, Homo sapiens; identical to SEQ ID NO: 535294
  misc_feature: HIJSMM301DBKT1.16.68.G02.1.454.light.4.raw

SEQ ID NO: 602159 - DNA, 494 bp, Homo sapiens; identical to SEQ ID NO: 534992
  misc_feature: HIJSMM301A8KZ7.9.1.A01.1.454.light.4.raw

SEQ ID NO: 602160 - DNA, 486 bp, Homo sapiens; identical to SEQ ID NO: 535043
  misc_feature: HIJSMM301BLG15.46.35.D02.1.454.light.4.raw

SEQ ID NO: 602161 - DNA, 484 bp, Homo sapiens; identical to SEQ ID NO: 535400
  misc_feature: HIJSMM301D7DEN.46.26.C04.1.454.light.4.raw

SEQ ID NO: 602162 - DNA, 491 bp, Homo sapiens
  misc_feature: HIJSMM301EIMYK.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagatttgcagtttattactgtcagcagtatgatacctggcctccgtacacttttggccggggaccaagctggaaatcaagcgaactgtggctgcaccatctgtcttcatt

SEQ ID NO: 602163 - DNA, 490 bp, Homo sapiens
  misc_feature: HIJSMM301BWC0K.13.73.G07.1.454.light.4.raw
tcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagtagggtggaggctgaggatgttattgggctctattattgcatgcaagcaacacactggccgtacacttttggccaggggaccaagctggagatcaatcgaactgtggctgca

SEQ ID NO: 602164 - DNA, 486 bp, Homo sapiens; identical to SEQ ID NO: 535385
  misc_feature: HIJSMM301B5QLD.19.71.G05.1.454.light.4.raw

SEQ ID NO: 602165 - DNA, 467 bp, Homo sapiens; identical to SEQ ID NO: 538403
  misc_feature: HIJSMM301DQHJY.41.48.E04.1.454.light.4.raw

SEQ ID NO: 602166 - DNA, 497 bp, Homo sapiens
  misc_feature: HIJSMM301CLPU1.43.39.D06.1.454.light.4.raw
tgtgagtagtcacgaccggtgctcgatttagtgacatctcgcagttctttggggagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtggggtctggggacagacttcactctcaccgtcagcagactggaccctgaagattttgcagtgtattactgtcagcagtatggtagctcaccgatcaccttcggccaagggacacgactggagattaaccgaactgtggctgcaccatctgtctt

SEQ ID NO: 602167 - DNA, 490 bp, Homo sapiens; identical to SEQ ID NO: 541974
  misc_feature: HIJSMM301C68Z0.22.65.F10.1.454.light.4.raw

SEQ ID NO: 602168 - DNA, 505 bp, Homo sapiens; identical to SEQ ID NO: 536117
  misc_feature: HIJSMM301CNL6Z.8.71.G05.1.454.light.4.raw

SEQ ID NO: 602169 - DNA, 505 bp, Homo sapiens; identical to SEQ ID NO: 546412
  misc_feature: HIJSMM301DDQE3.22.21.B10.1.454.light.4.raw

SEQ ID NO: 602170 - DNA, 488 bp, Homo sapiens; identical to SEQ ID NO: 551155
  misc_feature: HIJSMM301B0SND.3.33.C11.1.454.light.4.raw

SEQ ID NO: 602171 - DNA, 492 bp, Homo sapiens
  misc_feature: HIJSMM301DX81D.51.28.C06.1.454.light.4.raw
cgatcgtatacacgaccggtgctcgatttagagctcacgtattgggtttggggtgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacagcgacactgccgtgttcggcgggggaccaagctgaccgtcctcggtcagcccaaggctgccccctcggtcta

SEQ ID NO: 602172 - DNA, 515 bp, Homo sapiens
  misc_feature: HIJSMM301D24IG.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgagggctgattattattgtagttcatatacaaccagtgacacttgggtgttcggcggagggaccaggctgaccgtcctaggtcagccaaggctgcccctcggtcactctgttccc

SEQ ID NO: 602173 - DNA, 497 bp, Homo sapiens; identical to SEQ ID NO: 545146
  misc_feature: HIJSMM301AXCD3.43.25.C03.1.454.light.4.raw

SEQ ID NO: 602174 - DNA, 501 bp, Homo sapiens
  misc_feature: HIJSMM301DX417.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaacgccccccaagtcgttctctatgatgtcactaagcggccctcaggacgtccctgatcgattctctggctccaagtctggcaacacggcctccctgaacatctctgggctccaggctgaggatgaggctgattattattgctgctcatatggaagtacctacttcttttctcttcggaactcgggaccacggtcaccgtcctaggtcacgcccaaggcccaaccca

SEQ ID NO: 602175 - DNA, 510 bp, Homo sapiens
  misc_feature: HIJSMM301B4CHA.48.37.D04.1.454.light.4.raw
agtatacatacacgaccggtgctcgatttagtagcatactgttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgttcccacct

SEQ ID NO: 602176 - DNA, 475 bp, Homo sapiens
  misc_feature: HIJSMM301A58BB.3.38.D05.1.454.light.4.raw
agacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaaggttcagtggcagtggatctgggacagatttcactctcaccatcaacagtctgcaacctgaagattttgcaacttactactgtcaacagagtttcactaccctctcacgtttcggcggggggaccgaaggtggagatcaaacgaa

SEQ ID NO: 602177 - DNA, 355 bp, Homo sapiens
  misc_feature: HIJSMM301A39XN.19.22.B11.1.454.light.4.raw
tactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatattttatacaactcctaataataagaactacttagcttggttccagcagaaaccaggacagcctcctaagatgctcttttattgggcatctgcccgggaatccggggtccctgaccgattcagtggcagcgggtctgggacagatttcactctcacca

SEQ ID NO: 602178 - DNA, 492 bp, Homo sapiens
  misc_feature: HIJSMM301DQ5DI.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgtagtttattactgtcagcagtataatgactgggttttattcactttcggcctgggaccaaagtggatttcagacgaactgtggctgcaccatctgtcttcatt

SEQ ID NO: 602179 - DNA, 493 bp, Homo sapiens; identical to SEQ ID NO: 535084
  misc_feature: HIJSMM301APSFQ.47.64.F09.1.454.light.4.raw

SEQ ID NO: 602180 - DNA, 485 bp, Homo sapiens; identical to SEQ ID NO: 536075
  misc_feature: HIJSMM301D88YF.17.21.B10.1.454.light.4.raw

SEQ ID NO: 602181 - DNA, 486 bp, Homo sapiens; identical to SEQ ID NO: 535043
  misc_feature: HIJSMM301ASCXJ.46.35.D02.1.454.light.4.raw

SEQ ID NO: 602182 - DNA, 494 bp, Homo sapiens; identical to SEQ ID NO: 534992
  misc_feature: HIJSMM301BFDU4.9.1.A01.1.454.light.4.raw

SEQ ID NO: 602183 - DNA, 520 bp, Homo sapiens; identical to SEQ ID NO: 539176
  misc_feature: HIJSMM301DHHYA.27.23.C01.1.454.light.4.raw

SEQ ID NO: 602184 - DNA, 484 bp, Homo sapiens
  misc_feature: HIJSMM301B5JZL.51.76.G10.1.454.light.4.raw
cgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgaagattttgctaatttattactgttcagcagtataataactggcctccgtacacttttggccaggggaccaagctggagatcaaacgaactgtggctgcaccta

SEQ ID NO: 602185 - DNA, 440 bp, Homo sapiens; identical to SEQ ID NO: 578848
  misc_feature: HIJSMM301ELV37.11.3.A03.1.454.light.4.raw

SEQ ID NO: 602186 - DNA, 495 bp, Homo sapiens; identical to SEQ ID NO: 555142
  misc_feature: HIJSMM301DFHC9.9.1.A01.1.454.light.4.raw

SEQ ID NO: 602187 - DNA, 479 bp, Homo sapiens; identical to SEQ ID NO: 554716
  misc_feature: HIJSMM301A7H3V.41.34.D01.1.454.light.4.raw

SEQ ID NO: 602188 - DNA, 441 bp, Homo sapiens; identical to SEQ ID NO: 535074
  misc_feature: HIJSMM301EG45K.11.3.A03.1.454.light.4.raw

SEQ ID NO: 602189 - DNA, 489 bp, Homo sapiens
  misc_feature: HIJSMM301E15JD.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgtgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggccaggggaccaaactggatatcagacgaactgtggctgca

SEQ ID NO: 602190 - DNA, 501 bp, Homo sapiens
  misc_feature: HIJSMM301CHJ90.4.71.G05.1.454.light.4.raw
agcactgtagcacgaccggtgctcgatttagtgtcgtcgcaagagagagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccgccatcagctgcaagtccagccagagtgttttattcagctccaacaataagaactacttagcttggtaccagcagaaaccaggacagcctcctaacctgctcatttactgggcatctacccgggaatccggggtccctgaccgattcagtggcagcgggtctgggacagatttcactctcaccatcaacagcctgcaggctgaagatgtggcagtttattactgtcagcagtattatataactcccttcactttcggtcggagggaccgaaggtggaggatcaaacgaaactacgtggctcg

SEQ ID NO: 602191 - DNA, 509 bp, Homo sapiens; identical to SEQ ID NO: 576693
  misc_feature: HIJSMM301ARMAO.5.24.C02.1.454.light.4.raw

SEQ ID NO: 602192 - DNA, 497 bp, Homo sapiens; identical to SEQ ID NO: 535664
  misc_feature: HIJSMM301ANCJ7.22.14.B03.1.454.light.4.raw

SEQ ID NO: 602193 - DNA, 514 bp, Homo sapiens
  misc_feature: HIJSMM301BBDCN.7.39.D06.1.454.light.4.raw
cgtgtctctacacgaccggtgctcgatttagtgacatctcgcagttctttgggggtgggctcaggaggcagagctctgggaatctcaccatggcctggacccctctcctgctccccctcctcactttctgcacagtctctgaggcctcctatgaactgacacagccaccctcggtgtcagtatccccaggacaaacggccaggatcacctgctctggaaatccatcgccaataagatctgttcattggtaccaccagaggtccggccaggcccctgtgcttgtcgtctatgcggacacaaagcgcccctccgggatccctgagagattctctggctccagctcagggacagtggccaccttgactatcagcggggcccaggtggacgatgaaggtgactacttctgtttctcaatagacgccagcggtgaccatagggtgttcggcggagggaccagggtgaccgtcctaggtcagcccaaggctgccccctcggtcactctcgttcccgccct

SEQ ID NO: 602194 - DNA, 498 bp, Homo sapiens
  misc_feature: HIJSMM301DUJ4T.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccagggggaccaagctggagatcaaacgaactgtggctgcaccatctgtt

SEQ ID NO: 602195 - DNA, 506 bp, Homo sapiens
  misc_feature: HIJSMM301BFWL0.13.81.H04.1.454.light.4.raw
tcacgtactacacgaccggtgctcgatttagtagtgtagattcgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgtttgacttggcacaacaacgcctggatcttcggacctgggaccacggtcaccgtcctaggtcagcccaaggccaaccccactcgtcactctccg

SEQ ID NO: 602196 - DNA, 444 bp, Homo sapiens; identical to SEQ ID NO: 535027
  misc_feature: HIJSMM301C2N7K.8.73.G07.1.454.light.4.raw

SEQ ID NO: 602197 - DNA, 499 bp, Homo sapiens
  misc_feature: HIJSMM301D7LRG.51.14.B03.1.454.light.4.raw
cgatcgtatacacgaccggtgctcgatttagtgtgagtagttccgcgggggagtcagaccccgtcaggacacagcatggacatgagggtccccgctcagctcctggggctcctgctgctctggttcccaggttccagatgcgacatccagatgacccagtctccatcctccgtgtctgcatctgtaggagacagagtcaccatgacttgtcgggcgagtcagggtattgacgactacttagcctggcttcagcagaaaccagggaaagcccccaagctcttgatctatgctgcatccaggttggaaagtggggtcccatcaaggttcagcggcagtggatctgggacagatttcactctcaccatcagcagcctgcagcctgaagattttgcaacttattattgtcaacaggctaaaagttaccctctcactttcggcggagggaccaaggtagaaaccaaacgaactgtggctgcaccatctgtcttcatcttccccg

SEQ ID NO: 602198 - DNA, 495 bp, Homo sapiens; identical to SEQ ID NO: 538651
  misc_feature: HIJSMM301EA0CR.10.79.H02.1.454.light.4.raw

SEQ ID NO: 602199 - DNA, 476 bp, Homo sapiens; identical to SEQ ID NO: 538026
  misc_feature: HIJSMM301A01LU.13.76.G10.1.454.light.4.raw

SEQ ID NO: 602200 - DNA, 495 bp, Homo sapiens
  misc_feature: HIJSMM301EWO7H.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagtcaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactagtggctgcaccatctgtcttcatcttccccg

SEQ ID NO: 602201 - DNA, 498 bp, Homo sapiens
  misc_feature: HIJSMM301CILZK.11.12.B01.1.454.light.4.raw
cgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaaataccaggcggccctctggggtccctgagcgattctccggctccggctctgggaacacagtcactctgaccatcagcgggacccaggctattgatgaggctgtctacttctgtcaggcgtgggacaacagcgtggtggttcggcggagggaccagtctggaccgtcgttaggtcagcccaaggctcgccccctcggtccacttccg

SEQ ID NO: 602202 - DNA, 510 bp, Homo sapiens
  misc_feature: HIJSMM301CGTFO.17.2.A02.1.454.light.4.raw
  modified_base (438)..(438): a, c, t, g, unknown or other
cgtagactagcacgaccggtgctcgatttagactcatctacagggggggtagagaagacaggactcaggacaatctccagcatggccagcttccctctcctcctcaccctcctcactcactgtgcagggtcctgggcccagtctgtactgactcagccaccctcagcgtctgggacccccggacagagggtcaccatctcttgttctggaagcagctccaacatcgggactaatactgtaacctggttccagcacgtcccaggaacggcccccaaactcgtcatgtataattatagtcagcggccctcaggggtccctgaccgattcgctggctccaactctggcacctcagcctccctggccatcagtgggctccagtctgaggatgaggctgattattactgtgcagcatgggatgccagcctgagtagtcccgtnttcggaactgggaccaaggtcaccgtcctacgtcagcccaaggccaacccactgtcactctgttcccaccct

SEQ ID NO: 602203 - DNA, 488 bp, Homo sapiens; identical to SEQ ID NO: 539612
  misc_feature: HIJSMM301BNKDT.3.55.E11.1.454.light.4.raw

SEQ ID NO: 602204 - DNA, 493 bp, Homo sapiens; identical to SEQ ID NO: 535084
  misc_feature: HIJSMM301ELHVU.47.64.F09.1.454.light.4.raw

SEQ ID NO: 602205 - DNA, 483 bp, Homo sapiens; identical to SEQ ID NO: 535413
  misc_feature: HIJSMM301EI20C.26.78.H01.1.454.light.4.raw

SEQ ID NO: 602206 - DNA, 496 bp, Homo sapiens; identical to SEQ ID NO: 535109
  misc_feature: HIJSMM301D6C02.16.78.H01.1.454.light.4.raw

SEQ ID NO: 602207 - DNA, 494 bp, Homo sapiens; identical to SEQ ID NO: 600696
  misc_feature: HIJSMM301D4Q8G.16.53.E09.1.454.light.4.raw

SEQ ID NO: 602208 - DNA, 500 bp, Homo sapiens; identical to SEQ ID NO: 539795
  misc_feature: HIJSMM301DFSZE.22.38.D05.1.454.light.4.raw

SEQ ID NO: 602209 - DNA, 483 bp, Homo sapiens
  misc_feature: HIJSMM301CNUR4.14.56.F01.1.454.light.4.raw
cgtctagtaccacgaccggtgctcgatttagcagacgtctgaacacacaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgatttgcaacttattactgccaacagtatcatcatcattgtaatttcggtgagggaccaaggtggaggtcaaacgaactgtggctgcaccatct

SEQ ID NO: 602210 - DNA, 493 bp, Homo sapiens; identical to SEQ ID NO: 535745
  misc_feature: HIJSMM301CL8XT.47.78.H01.1.454.light.4.raw

SEQ ID NO: 602211 - DNA, 444 bp, Homo sapiens; identical to SEQ ID NO: 535192
  misc_feature: HIJSMM301EJ84U.5.9.A09.1.454.light.4.raw

SEQ ID NO: 602212 - DNA, 501 bp, Homo sapiens
  misc_feature: HIJSMM301BJ0SW.21.27.C05.1.454.light.4.raw
tcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggagcgccaccctctcctgcacagccagtcagtctatcgctgactggttagcctggtaccagcagaaatctggccaggctcccaggctcctcatttaccgtgcatccaccagggccactggtgtcccagacaggttcagtggcggtggatttgggacagagttttctctcaccatcagcgccctacagagtgaagatgttgctagtttatttctgccagcaatataattactggcctgcgtcgacgttcggccgacggaccgaaggtaggaaatacaaacgaactagtggctgcaccactctgtctt

SEQ ID NO: 602213 - DNA, 512 bp, Homo sapiens
  misc_feature: HIJSMM301DKEXQ.15.34.D01.1.454.light.4.raw
tctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggcatttgggtgttcggcggagggaccaaactgaccgtcctaggtcagcccaaggctgccccctcggtcactctgttccccaccctcctcgctacgtaga

SEQ ID NO: 602214 - DNA, 513 bp, Homo sapiens; identical to SEQ ID NO: 535719
  misc_feature: HIJSMM301B4SK5.17.33.C11.1.454.light.4.raw

SEQ ID NO: 602215 - DNA, 496 bp, Homo sapiens; identical to SEQ ID NO: 535109
  misc_feature: HIJSMM301C5Z8S.16.78.H01.1.454.light.4.raw

SEQ ID NO: 602216 - DNA, 493 bp, Homo sapiens; identical to SEQ ID NO: 536769
  misc_feature: HIJSMM301CABYO.19.83.H06.1.454.light.4.raw

SEQ ID NO: 602217 - DNA, 478 bp, Homo sapiens
  misc_feature: HIJSMM301A3ZT0.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggtttcggcggagggaccaagctgaccgtcctaagtcagacccg

SEQ ID NO: 602218 - DNA, 496 bp, Homo sapiens
  misc_feature: HIJSMM301AXXCM.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcgccgaagggaccaaagtaggacgatcaagcgaactacgtggctgcaccatactgtt

SEQ ID NO: 602219 - DNA, 504 bp, Homo sapiens
  misc_feature: HIJSMM301CD3NT.43.14.B03.1.454.light.4.raw
tgtgagtagtcacgaccggtgctcgatttagtgtgagtagttccgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcacttatgtcttcggaactgggaccaaggtcaccgacctaggtcagcccaaggccaaccccactgtca

SEQ ID NO: 602220 - DNA, 507 bp, Homo sapiens; identical to SEQ ID NO: 572665
  misc_feature: HIJSMM301B3RTV.3.37.D04.1.454.light.4.raw

SEQ ID NO: 602221 - DNA, 365 bp, Homo sapiens
  misc_feature: HIJSMM301B7O2T.5.24.C02.1.454.light.4.raw
  modified_base (362)..(362): a, c, t, g, unknown or other
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacncgc

SEQ ID NO: 602222 - DNA, 521 bp, Homo sapiens; identical to SEQ ID NO: 538715
  misc_feature: HIJSMM301D6R09.27.23.C01.1.454.light.4.raw

SEQ ID NO: 602223 - DNA, 505 bp, Homo sapiens
  misc_feature: HIJSMM301AW8D9.7.21.B10.1.454.light.4.raw
cgtgtctctacacgaccggtgctcgatttagtgtcgtcgcaagagaggagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctcgggaccaagtaggatatcaaacgaactgtggctgcaccatctgt

SEQ ID NO: 602224 - DNA, 497 bp, Homo sapiens
  misc_feature: HIJSMM301BB9TY.4.37.D04.1.454.light.4.raw
agcactgtagcacgaccggtgctcgatttagtagcatactgttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaagcccccaaactcataatttatgatgtcagtaatcggccctcaggggtttctaatcgcttctctggttacaagtctggcaacacggcctcctgaccatctctgggctccaggctgaggacgaggctgattattactgcagctcatatacaagcagcagcactggggtcttcggaactgggaccaaggtcaccgtcgtcccacgtcagcccaa

SEQ ID NO: 602225 - DNA, 488 bp, Homo sapiens; identical to SEQ ID NO: 540827
  misc_feature: HIJSMM301DAFOF.15.49.E05.1.454.light.4.raw

SEQ ID NO: 602226 - DNA, 499 bp, Homo sapiens
  misc_feature: HIJSMM301BZ21D.51.83.H06.1.454.light.4.raw
cgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagtttattattgtcagcagcgaaacaactggcctccttggacgttcggccgaagggaccgaaggtaggaatacaaacgaactgtggctgcaccatctgtcttcatt

SEQ ID NO: 602227 - DNA, 490 bp, Homo sapiens; identical to SEQ ID NO: 543909
  misc_feature: HIJSMM301DZHZ6.14.55.E11.1.454.light.4.raw

SEQ ID NO: 602228 - DNA, 501 bp, Homo sapiens; identical to SEQ ID NO: 560349
  misc_feature: HIJSMM301AO242.18.26.C04.1.454.light.4.raw

SEQ ID NO: 602229 - DNA, 522 bp, Homo sapiens
  misc_feature: HIJSMM301C8SKL.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctccgtggggggagagccaccctctcctgcagggccagtgaaccttttagtagtagttatttagcctggtatcggacaaaaacctggccaggctccccgactcctcttctttggtggagcctacagggccactggccaccccagacaggatcagtggcagcgggtctgggacagacttcattctcaccatcaacagactgcagcctgaagatattgcagtttactactgtcagcagtatgttacgtccccgtggacgttcggccaaggaccgaaggtggcaatcaaccgaactagtggctgcaccatctgtcttcatcttccccg

SEQ ID NO: 602230 - DNA, 509 bp, Homo sapiens
  misc_feature: HIJSMM301D3AOF.14.7.A07.1.454.light.4.raw
cgtctagtaccacgaccggtgctcgatttagcacgtgtcgcagggggccctgaggaaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtcttttggggtccctgatcgcttctctggctccatccttgggaacaaggctgccctcaccatcacgggggcccaggcagatgatgaatctaattatcactgtgcgttgtatatgggttttggcattttcggtgttcggcggagggacccaggtgaccgtcctacgtcagccc

SEQ ID NO: 602231 - DNA, 493 bp, Homo sapiens
  misc_feature: HIJSMM301D6RCT.51.59.F04.1.454.light.4.raw
cgatcgtatacacgaccggtgctcgatttagtacacacacttagggattgggggctgtgggtccaggaggcagaactctgggtgtctcaccatggcctggatccctctacttctccccctcctcactctctgcacaggctctgaggcctcctatgagctgacacagccacctcggtgtcagtgtccccaggacagacggccaggatcacctgctctgaagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattatgtcaatcaacagacaccattggtacttatgtcttcggaactgcgaccaaggtcaccgtcctgggtcagcccaaggccaacccgactgt

SEQ ID NO: 602232 - DNA, 516 bp, Homo sapiens
  misc_feature: HIJSMM301CUD6U.16.46.E02.1.454.light.4.raw
tgtactactccacgaccggtgctcgatttagactcatctacagggaaagggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaattacttttgtcttcggaactgggaccaaggtccaccgtcctaggtcagcccaaggcccaaccccactgtcactcttccg

SEQ ID NO: 602233 - DNA, 494 bp, Homo sapiens; identical to SEQ ID NO: 553467
  misc_feature: HIJSMM301A9YVA.13.67.G01.1.454.light.4.raw

SEQ ID NO: 602234 - DNA, 509 bp, Homo sapiens
  misc_feature: HIJSMM301BVZMX.9.12.B01.1.454.light.4.raw
  modified_base (429)..(429): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttcncgggcgttcggtccaacgggaccaaggtggaaatacaaacgaactagtggctgcgaccatctgtcttctatctttccccg

SEQ ID NO: 602235 - DNA, 494 bp, Homo sapiens; identical to SEQ ID NO: 534992
  misc_feature: HIJSMM301EI8PQ.9.1.A01.1.454.light.4.raw

SEQ ID NO: 602236 - DNA, 482 bp, Homo sapiens
  misc_feature: HIJSMM301DO7DT.12.10.A10.1.454.light.4.raw
atacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaaagcccctaacgtcctgatctatggtgcatccactttgcatagtggggtcccatcaaggttcagcggcagtggatctgggacagaattcactctcacaatcaccagcctgcagcctgaagattttgcaacttattactgtcaacaggtttatatttaccctcgtattttcggccctgggaccacagtagatatcaaacgaactgtggctgcacccat

SEQ ID NO: 602237 - DNA, 484 bp, Homo sapiens; identical to SEQ ID NO: 535400
  misc_feature: HIJSMM301CEX1B.46.26.C04.1.454.light.4.raw

SEQ ID NO: 602238 - DNA, 501 bp, Homo sapiens; identical to SEQ ID NO: 536142
  misc_feature: HIJSMM301EL18R.15.1.A01.1.454.light.4.raw

SEQ ID NO: 602239 - DNA, 514 bp, Homo sapiens; identical to SEQ ID NO: 589602
  misc_feature: HIJSMM301BB9Y7.14.19.B08.1.454.light.4.raw

SEQ ID NO: 602240 - DNA, 514 bp, Homo sapiens; identical to SEQ ID NO: 545978
  misc_feature: HIJSMM301AISEZ.17.33.C11.1.454.light.4.raw

SEQ ID NO: 602241 - DNA, 494 bp, Homo sapiens; identical to SEQ ID NO: 535629
  misc_feature: HIJSMM301A1DPD.4.27.C05.1.454.light.4.raw

SEQ ID NO: 602242 - DNA, 512 bp, Homo sapiens
  misc_feature: HIJSMM301A3YMR.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggcttccggtccgaggatgaggctgacttattactgtgcatcacggggacgcaaacatgggatgaacaatctgagcgggttgggtgttcggcggaagggaccaaaactgaacccgtcctaggtcagcccaa

SEQ ID NO: 602243 - DNA, 486 bp, Homo sapiens
  misc_feature: HIJSMM301B5NFU.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtccaagtaactttggccgagggaccaagcgtggagatacaaacgaactgtgctgcaccat

SEQ ID NO: 602244 - DNA, 510 bp, Homo sapiens; identical to SEQ ID NO: 537801
  misc_feature: HIJSMM301D98UZ.5.60.F05.1.454.light.4.raw

SEQ ID NO: 602245 - DNA, 484 bp, Homo sapiens; identical to SEQ ID NO: 535400
  misc_feature: HIJSMM301E1PBZ.46.26.C04.1.454.light.4.raw

SEQ ID NO: 602246 - DNA, 486 bp, Homo sapiens; identical to SEQ ID NO: 541163
  misc_feature: HIJSMM301EIQH7.19.57.F02.1.454.light.4.raw

SEQ ID NO: 602247 - DNA, 497 bp, Homo sapiens
  misc_feature: HIJSMM301BJN3Q.13.38.D05.1.454.light.4.raw
tcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgaactagt

SEQ ID NO: 602248 - DNA, 502 bp, Homo sapiens
  misc_feature: HIJSMM301B7RZO.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttggccaagggacacgactggagattaaacg

SEQ ID NO: 602249 - DNA, 494 bp, Homo sapiens; identical to SEQ ID NO: 534994
  misc_feature: HIJSMM301B88F9.27.78.H01.1.454.light.4.raw

SEQ ID NO: 602250 - DNA, 502 bp, Homo sapiens
  misc_feature: HIJSMM301CUX3G.8.24.C02.1.454.light.4.raw
ctcgcgtgtccacgaccggtgctcgatttagtacagatcgttagggaaagggggggtctcaggaggcagcgctctcgggacgtctccaccatggcctgggctctgttattcctcaccctcctcactcagggcacagggtccagggcccaatctgccctgactcagcctgcctccgtgtctgggtcgcctggacagtccgtcaccatctcctgcactggaagcagcagtgacattggttcttataatcatgtctcctggtaccaacagcaccccggcagagcccccaaactcatcatttatgatgtcactgatcgccctcaggggtttcgaatcgcttctctggctccaagtctggcaacacggcctccctgaccatctctgggctccaggctgaggacgaggctcattattattgcagttcatatacgaccagcagcactctcgtggtcttcggcggagggaccaagttgaccgtcctaagtcagcccaaggctgccccctc

SEQ ID NO: 602251 - DNA, 486 bp, Homo sapiens; identical to SEQ ID NO: 535043
  misc_feature: HIJSMM301BD3TV.46.35.D02.1.454.light.4.raw

SEQ ID NO: 602252 - DNA, 502 bp, Homo sapiens; identical to SEQ ID NO: 541971
  misc_feature: HIJSMM301EQ1TL.4.39.D06.1.454.light.4.raw

SEQ ID NO: 602253 - DNA, 506 bp, Homo sapiens; identical to SEQ ID NO: 554661
  misc_feature: HIJSMM301DCPVM.3.79.H02.1.454.light.4.raw

SEQ ID NO: 602254 - DNA, 441 bp, Homo sapiens
  misc_feature: HIJSMM301EU6K8.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggctatcactgggctccagcctgaggatgaggctgattattactgtcagtcctttgacattaaactggatgtggtattcggcggagggacccacgtaaccgtcctaggtcagcccaaggctgccccctcggtcactctgttcccaccctcctcgtatctctcg

SEQ ID NO: 602255 - DNA, 520 bp, Homo sapiens; identical to SEQ ID NO: 579486
  misc_feature: HIJSMM301AHCL1.5.27.C05.1.454.light.4.raw

SEQ ID NO: 602256 - DNA, 496 bp, Homo sapiens
  misc_feature: HIJSMM301B4IHN.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgcaacagtataagagttatccgtggacgttcggccaagggaccagggtggaaatacaaacgaactagtggctgcaccatctgtcttcatt

SEQ ID NO: 602257 - DNA, 500 bp, Homo sapiens; identical to SEQ ID NO: 563448
  misc_feature: HIJSMM301C4A30.22.27.C05.1.454.light.4.raw

SEQ ID NO: 602258 - DNA, 504 bp, Homo sapiens; identical to SEQ ID NO: 538940
  misc_feature: HIJSMM301EO4E7.2.35.D02.1.454.light.4.raw

SEQ ID NO: 602259 - DNA, 485 bp, Homo sapiens
  misc_feature: HIJSMM301BOB3B.11.12.B01.1.454.light.4.raw
cgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaataccaggcggcctctggggtccctgagcgattctccggctccggctctgggaacacagtcactctgaccatcagcgggacccaggctatgatgaggctgtctacttctgtcaggcgtggacaacagcgtggtgttcggcggagggaccagtctgaccgtcttaggtcagcccaaggctgccccctggtccact

SEQ ID NO: 602260 - DNA, 501 bp, Homo sapiens
  misc_feature: HIJSMM301C2VZH.19.78.H01.1.454.light.4.raw
tactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtcactcctgttccccaccctcctccacgagagta

SEQ ID NO: 602261 - DNA, 470 bp, Homo sapiens
  misc_feature: HIJSMM301BQJE8.49.4.A04.1.454.light.4.raw
agtcgagagacacgaccggtgctcgatttagagtagtgatcaggggcaggagtcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtatgatcgcctcccgctcactttcggcggggggaccgaaggtggagatcaagcgaactgt

SEQ ID NO: 602262 - DNA, 482 bp, Homo sapiens; identical to SEQ ID NO: 535216
  misc_feature: HIJSMM301CDEKL.17.26.C04.1.454.light.4.raw

SEQ ID NO: 602263 - DNA, 509 bp, Homo sapiens
  misc_feature: HIJSMM301DS3VD.11.67.G01.1.454.light.4.raw
cgagagataccacgaccggtgctcgatttagagtatacatattgggtttgggggggttgagaagacaggactcaggacaatctccagcatggccagcttccctctcctcctcaccctcctcactcactgtgcagggtcctgggcccagtctgttctgactcagccaccctcagcgtctgggacccccgggcagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctggcacctcagcctccctggcctgcagtgggctccagtctgaggatgaggctgactattattgtgcagcgtgggatggacggtctgagtgctgtggtcttcggcggagggaccaagctgaccgtcctgggtcagcccaaggctgccccctcggtcacttcc

SEQ ID NO: 602264 - DNA, 494 bp, Homo sapiens; identical to SEQ ID NO: 535276
  misc_feature: HIJSMM301B6LS7.16.6.A06.1.454.light.4.raw

SEQ ID NO: 602265 - DNA, 498 bp, Homo sapiens; identical to SEQ ID NO: 602194
  misc_feature: HIJSMM301DVWD6.16.78.H01.1.454.light.4.raw

SEQ ID NO: 602266 - DNA, 504 bp, Homo sapiens; identical to SEQ ID NO: 545659
  misc_feature: HIJSMM301ANW8X.7.71.G05.1.454.light.4.raw

SEQ ID NO: 602267 - DNA, 522 bp, Homo sapiens
  misc_feature: HIJSMM301DJ69U.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctggaccgtcctaggtcagcccaaggctgccccctcggtcactctcgttcccacct

SEQ ID NO: 602268 - DNA, 485 bp, Homo sapiens; identical to SEQ ID NO: 535688
  misc_feature: HIJSMM301CJW0W.19.5.A05.1.454.light.4.raw

SEQ ID NO: 602269 - DNA, 512 bp, Homo sapiens
  misc_feature: HIJSMM301E3VTK.21.87.H10.1.454.light.4.raw
tcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaaactcttaatttctggcgtcaatcagcgaccctcacatgtttccagtcgattctctgcatccaagtctggcaacacggcctttctgacaatctctcaactccaggctgaagacgaggctatttattactgctcctcatacgcaggtggcacatttttcttggtttttggtcggcgggacccgacgatgactgtcctcagtcagccaacggctcgccccctccggt

SEQ ID NO: 602270 - DNA, 485 bp, Homo sapiens; identical to SEQ ID NO: 535606
  misc_feature: HIJSMM301ECOU2.47.46.E02.1.454.light.4.raw

SEQ ID NO: 602271 - DNA, 499 bp, Homo sapiens; identical to SEQ ID NO: 572008
  misc_feature: HIJSMM301ALZJE.14.35.D02.1.454.light.4.raw

SEQ ID NO: 602272 - DNA, 505 bp, Homo sapiens; identical to SEQ ID NO: 536342
  misc_feature: HIJSMM301CMVSU.10.88.H11.1.454.light.4.raw

SEQ ID NO: 602273 - DNA, 510 bp, Homo sapiens
  misc_feature: HIJSMM301CKE3I.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggccgtccggggccactttcggccctcgggaccgaaggtggagatcaaacgaactgtggctgcaccatctgtcttcta

SEQ ID NO: 602274 - DNA, 497 bp, Homo sapiens; identical to SEQ ID NO: 575896
  misc_feature: HIJSMM301BWIM7.9.71.G05.1.454.light.4.raw

SEQ ID NO: 602275 - DNA, 485 bp, Homo sapiens; identical to SEQ ID NO: 560408
  misc_feature: HIJSMM301D1A0X.5.40.D07.1.454.light.4.raw

SEQ ID NO: 602276 - DNA, 516 bp, Homo sapiens
  misc_feature: HIJSMM301D3U7R.13.55.E11.1.454.light.4.raw
tcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtggccccgggacagacggccacaattccctgtgagggaaacaaccttagaagtcagaatgtccactggtaccagcagaagtcaggccaggcccctgtggtggtcatctatagggataataaccggccctctgggatccctgaccgattctctggctccaactcggggaacacggccaccctgaccatcaacagagcccaagacggggatgaggctgactattattgtcaggtgtgggacagcaccacggtgatattcggcggcgggaccaaggctgaccgtcctaggtcagcccaaggctgccccctcggtcactctgttcccgcctcctct

SEQ ID NO: 602277 - DNA, 506 bp, Homo sapiens
  misc_feature: HIJSMM301A82PN.15.59.F04.1.454.light.4.raw
tctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatggtgctggcatttcggtcttcggcggagggaccaagctgaccgtcctaggtcagcccaaggctgccccctcggt

SEQ ID NO: 602278 - DNA, 523 bp, Homo sapiens
  misc_feature: HIJSMM301AD426.17.37.D04.1.454.light.4.raw
cgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctgtgggggaaacaatgttggaagtaaaactgtgcactggtaccagcagaagccaggccaggcccctgtgctggtcgtctatgatgataccgaccggccctcagggatccctgagcgattctctggctccaactctgggaacacggccaccctgaccatcggcagggtcgaagccggggatggaggccgactatttattgtcaggtgtgggatagtagtagtgatcatgtggtagttcggcgggagggaccgaagctcgaccgtccttggtcacgcccaaggctcgccccctcggtcactctcgttcccaccct

SEQ ID NO: 602279 - DNA, 516 bp, Homo sapiens
  misc_feature: HIJSMM301BO4L5.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtccactctgttcccgccctcctcgctacgtagac

SEQ ID NO: 602280 - DNA, 445 bp, Homo sapiens
  misc_feature: HIJSMM301CI84N.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggcctgccccctcggtcactctgttccccaccccctccgtgtctgat

SEQ ID NO: 602281 - DNA, 461 bp, Homo sapiens
  misc_feature: HIJSMM301CY65P.49.8.A08.1.454.light.4.raw
agtcgagagacacgaccggtgctcgatttagcatactctacagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggacagcccctaagctcctgatcctcgatgcatccactttggaaacaggggtcccatcaaggttcagtggaagtggctctgggacagattttactttcaccatcagcagactgcagcctgaagatattgcaacatattactgtcaacagtatgatagtctcccgctcactttcggcggaggaccaaggtggagatcaaacgaa

SEQ ID NO: 602282 - DNA, 483 bp, Homo sapiens; identical to SEQ ID NO: 535413
  misc_feature: HIJSMM301BTMHK.26.78.H01.1.454.light.4.raw

SEQ ID NO: 602283 - DNA, 515 bp, Homo sapiens
  misc_feature: HIJSMM301A76Y4.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcagtgggcccaagtggaggatgaagctgactactactgttactcaatagagaacagtgataatttctggttgttcggcggagggaccaaaactcgaaccgtcctaaggtcagcccaaggctcgccccctcggtcactctgttcccccg

SEQ ID NO: 602284 - DNA, 492 bp, Homo sapiens
  misc_feature: HIJSMM301BORF3.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacctttcggcggagggaccgaaggcggaggatcagacgaactgtggctgcaccatctgtcttcta

SEQ ID NO: 602285 - DNA, 484 bp, Homo sapiens
  misc_feature: HIJSMM301CTMO5.17.26.C04.1.454.light.4.raw
cgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccccctggctcactttcggcggagggaccaaggtggagatcaaacgaactgtggctgcacc

SEQ ID NO: 602286 - DNA, 491 bp, Homo sapiens
  misc_feature: HIJSMM301C8AAQ.41.11.A11.1.454.light.4.raw
tctatactatcacgaccggtgctcgatttagctacgactgcaggggggaggaactgctcagttaggacccagacggaaccatggaagccccagcgcagcttctcttcctcctgctactctggctcccagataccactggagaaatagtggtgacgcagtctccagccaccctgtctgtgtctccaggggaaggagccaccctctcctgcagggccagtcagagtattagcagcagcttagcctggtaccagcagaagcctggccaggctcccaggctcctcgtctatggtgcatccaccagggccactggtatcccagccaggttcagtggcagtgggtctgggacagagttcactctcaccatcaccagcctgcagtctgaagtattttggagttttattctgtcaccagtataaggactggccttggtaactttggccgagggaccgaagctggagatcagacgaactgtggctgcacatctgtcttct

SEQ ID NO: 602287 - DNA, 487 bp, Homo sapiens
  misc_feature: HIJSMM301BDRR2.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatacaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 602288 - DNA, 487 bp, Homo sapiens; identical to SEQ ID NO: 559542
  misc_feature: HIJSMM301EUOOY.26.23.C01.1.454.light.4.raw

SEQ ID NO: 602289 - DNA, 377 bp, Homo sapiens; identical to SEQ ID NO: 536071
  misc_feature: HIJSMM301CX5N4.40.9.A09.1.454.light.4.raw

SEQ ID NO: 602290 - DNA, 454 bp, Homo sapiens; identical to SEQ ID NO: 534964
  misc_feature: HIJSMM301CUCT8.19.86.H09.1.454.light.4.raw

SEQ ID NO: 602291 - DNA, 485 bp, Homo sapiens; identical to SEQ ID NO: 536075
  misc_feature: HIJSMM301CAPDL.17.21.B10.1.454.light.4.raw

SEQ ID NO: 602292 - DNA, 454 bp, Homo sapiens; identical to SEQ ID NO: 534964
  misc_feature: HIJSMM301DBNUM.19.86.H09.1.454.light.4.raw

SEQ ID NO: 602293 - DNA, 469 bp, Homo sapiens
  misc_feature: HIJSMM301AYW0N.51.34.D01.1.454.light.4.raw
cgatcgtatacacgaccggtgctcgatttagatcgtctgtgttgggtttgggggcagaagtctctctcagtcaggacacagcatggacatgagggtccctgctcagctcctgggactcctgctgctctggctcccagataccagatgtgacatccagatgacccagtctccatcctccctgtctgcatctataggagacagagtcaccatcacttgccgggcgagtcagggcgtcagcatttatttggcctggtatcagcagagaccagggaaagctcctaaactcctgatctatgaggcatccactttacaatcaggggtcccatctcgtttcagtggcagtggatctggggcacatttcactctcaccatcagcagcctgcagcctgacgatgttgcaacttattactgtcaaaattataacaggccgttgcgctcactttcggcggggggaccgaaggtggagatc

SEQ ID NO: 602294 - DNA, 490 bp, Homo sapiens
  misc_feature: HIJSMM301CS3GQ.13.10.A10.1.454.light.4.raw
tcacgtactacacgaccggtgctcgatttagcgtcgatctcagggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacagctcagtctctagtagttactacccagctggtaccaacagaccccaggccaggctccgcgcacgctcatctacaacacaaacactcgctcttctgggtccctcatcgcttctctggctccatccttggaacaaagctgcccttatcatcacggggcccaggcagaagatgaatctgattattactgtgttctttatatgggtagtgccatttctgtctgtgttcggaggaggcaccggctgaccgtccgtcggtcagcccaaggctg

SEQ ID NO: 602295 - DNA, 495 bp, Homo sapiens
  misc_feature: HIJSMM301A0YAQ.27.78.H01.1.454.light.4.raw
  modified_base (488)..(488): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactacttttacctcaagtgatcaccttcggccaagggacacgactggagattaaacgaactgtggctgcaccanctgtctt

SEQ ID NO: 602296 - DNA, 475 bp, Homo sapiens; identical to SEQ ID NO: 551399
  misc_feature: HIJSMM301CNKGD.4.79.H02.1.454.light.4.raw

SEQ ID NO: 602297 - DNA, 454 bp, Homo sapiens; identical to SEQ ID NO: 534964
  misc_feature: HIJSMM301C14GU.19.86.H09.1.454.light.4.raw

SEQ ID NO: 602298 - DNA, 489 bp, Homo sapiens; identical to SEQ ID NO: 540247
  misc_feature: HIJSMM301B1F7I.48.75.G09.1.454.light.4.raw

SEQ ID NO: 602299 - DNA, 500 bp, Homo sapiens
  misc_feature: HIJSMM301BB4E5.22.57.F02.1.454.light.4.raw
acatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcaatggatctgggacagaattcactctcaccatcaacagcctgcagcctgatgatttggcaacttactactgccaaccgtatagtacttattcggtcacccttcggtccaagggacacgactggagattaaacgaactagtggcgtgcaccactactgtcttctat

SEQ ID NO: 602300 - DNA, 521 bp, Homo sapiens; identical to SEQ ID NO: 539470
  misc_feature: HIJSMM301C0RSF.27.23.C01.1.454.light.4.raw

SEQ ID NO: 602301 - DNA, 511 bp, Homo sapiens
  misc_feature: HIJSMM301DSVVG.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcatgatttatgatgtcagtaatcggccctcaggggtttctaatcgcttctctggctccaagtctggcaacacggcctccctgaccatctctgggctccaggctgaggacgaggctgattattactgcttctcatatgcagatactaagtcctgggtgttcggcggagggaccaagctgaccgtcctgggtcagcccaaggctgccccctcggtccactcttccg

SEQ ID NO: 602302 - DNA, 489 bp, Homo sapiens
  misc_feature: HIJSMM301BT192.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcaacaatattataataatccatttaattcggcggagggaccaaggtgagatcaaacgaactgtggctgcaccatctgtcttcatcttcccgcta

SEQ ID NO: 602303 - DNA, 501 bp, Homo sapiens
  misc_feature: HIJSMM301DP4WP.10.68.G02.1.454.light.4.raw
catagtagtgcacgaccggtgctcgattagtcgatagtgaagggaaaggggggtgtgggctcaggaggcagagctctgggaatctcaccatggcctggacccctctcctgctccccctcctcactttctgcacagtctctgaggcctcgtatgaactgacacagccaccctcggtgtccagtgtccccaggacagactgccaggatcagctgctctggagatgcattgccaacaaaatatgcttattggtacgagcaaaagccaggccaggcccctgtcttgttgatatatgaggacaccaagcgaccctccggaatttctgagagattctccggctccagctcagggacagtggcctccttgactatcagtggggcccagggggtcgatgaggctgactactactgtttctcgactgacttcactggtaaacgttggctgttcggcggagggaccaagctgaccgtcctgcgtcagcccaaggctgccccctcggtcact

SEQ ID NO: 602304 - DNA, 493 bp, Homo sapiens; identical to SEQ ID NO: 538503
  misc_feature: HIJSMM301D2AQG.9.1.A01.1.454.light.4.raw

SEQ ID NO: 602305 - DNA, 445 bp, Homo sapiens; identical to SEQ ID NO: 543451
  misc_feature: HIJSMM301AGDYK.9.71.G05.1.454.light.4.raw

SEQ ID NO: 602306 - DNA, 484 bp, Homo sapiens; identical to SEQ ID NO: 569020
  misc_feature: HIJSMM301DCWL0.40.83.H06.1.454.light.4.raw

SEQ ID NO: 602307 - DNA, 490 bp, Homo sapiens
  misc_feature: HIJSMM301A4Y5A.49.20.B09.1.454.light.4.raw
agtcgagagacacgaccggtgctcgatttagtgtagtgtgaagggggagaagtagagggatccagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacaatatgcttactggtaccagcagaggccaggccaggcccctgtcttggtgatttataaagactttgagaggccctcagggacccctgagcgattctctggctccagctcagggacaacagtcaccttgaccatcagtggagtccggccagaggacgaggctgactattactgtcagtccgcagacagcagtggcagttatgtcgtattcggcggagggactacgctgaccgtcctaggtcagcccaaggctgccccctggtc

SEQ ID NO: 602308 - DNA, 505 bp, Homo sapiens; identical to SEQ ID NO: 546412
  misc_feature: HIJSMM301CPNZ8.22.21.B10.1.454.light.4.raw

SEQ ID NO: 602309 - DNA, 504 bp, Homo sapiens
  misc_feature: HIJSMM301BXZXG.16.9.A09.1.454.light.4.raw
tgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctggagataacctgggaagtaaatttactttctggtatcagcggaagccaggccagtcccctgtttggtcatctataaagataggaatcggccctcagacatccctgagcgattctctggctccagctctggaaacacagccactctgaccatcaccgggacccagactatggatgaagctgactattactgtcaggcgtggacagcggcactgtggttttcggcggtagggaccaagctgaccgtcctcggtcagcccaaggctgccccctcggtcactctcgttcccaccctccc

SEQ ID NO: 602310 - DNA, 492 bp, Homo sapiens; identical to SEQ ID NO: 557028
  misc_feature: HIJSMM301D1UZG.51.6.A06.1.454.light.4.raw

SEQ ID NO: 602311 - DNA, 434 bp, Homo sapiens; identical to SEQ ID NO: 535153
  misc_feature: HIJSMM301BYOYP.18.5.A05.1.454.light.4.raw

SEQ ID NO: 602312 - DNA, 514 bp, Homo sapiens
  misc_feature: HIJSMM301DLVS8.49.34.D01.1.454.light.4.raw
agtcgagagacacgaccggtgctcgatttagatcgtctgtgttgggtttgggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgaccaaaaagatatgcttattggtaccatcagaagtcaggccaggcccctgtactggtcatctatgaggacaccaaacgaccctccgggatccctacgagattctctggctccagtttaggacagtggccaccctgacagtcaggtggggcccaggtggaggatggagggtgattactactgttactcaacagactattactactactctagtagggtgttcggcggagggaccaagctgaccgtctaggtcacgccaaggctcgcccctcgtcactctcgtcccgcct

SEQ ID NO: 602313 - DNA, 479 bp, Homo sapiens; identical to SEQ ID NO: 537141
  misc_feature: HIJSMM301B311P.7.76.G10.1.454.light.4.raw

SEQ ID NO: 602314 - DNA, 493 bp, Homo sapiens; identical to SEQ ID NO: 535657
  misc_feature: HIJSMM301DCLNO.27.78.H01.1.454.light.4.raw

SEQ ID NO: 602315 - DNA, 508 bp, Homo sapiens; identical to SEQ ID NO: 538141
  misc_feature: HIJSMM301A0MWR.18.37.D04.1.454.light.4.raw

SEQ ID NO: 602316 - DNA, 508 bp, Homo sapiens; identical to SEQ ID NO: 576837
  misc_feature: HIJSMM301A7XYH.19.78.H01.1.454.light.4.raw

SEQ ID NO: 602317 - DNA, 516 bp, Homo sapiens
  misc_feature: HIJSMM301E0UII.40.67.G01.1.454.light.4.raw
tctagcgactcacgaccggtgctcgatttagagtatacatattgggtttgggcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtgggtctgggacagccttcactctcaccatcagcagcctggagcccgaagatttgcggtttattactgtcagcagcgtgccgactggcccctcacgttcggcggagggaccaaggtggacatcaaacgaactgt

SEQ ID NO: 602318 - DNA, 507 bp, Homo sapiens; identical to SEQ ID NO: 557429
  misc_feature: HIJSMM301D0ZXD.15.59.F04.1.454.light.4.raw

SEQ ID NO: 602319 - DNA, 521 bp, Homo sapiens
  misc_feature: HIJSMM301D6BKP.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtctaggtcagcccaaggctgccccctcggtccactctgttccccgcct

SEQ ID NO: 602320 - DNA, 485 bp, Homo sapiens
  misc_feature: HIJSMM301EA5SI.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaatttattactgtcagcaatataatacctggcctccgctcactttcggcgagggaccaaggttgagatcaaacgaactgtgctgcaca

SEQ ID NO: 602321 - DNA, 497 bp, Homo sapiens; identical to SEQ ID NO: 535764
  misc_feature: HIJSMM301BQ6A3.22.20.B09.1.454.light.4.raw

SEQ ID NO: 602322 - DNA, 518 bp, Homo sapiens
  misc_feature: HIJSMM301EZN67.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggccgaacggaccgaacggtaggaagtacgaaacgaactacgtaggcgtgcaccatctgtcttctactcttcccgtccact

SEQ ID NO: 602323 - DNA, 478 bp, Homo sapiens; identical to SEQ ID NO: 535129
  misc_feature: HIJSMM301A75DV.11.11.A11.1.454.light.4.raw

SEQ ID NO: 602324 - DNA, 505 bp, Homo sapiens
  misc_feature: HIJSMM301B2Z2W.14.7.A07.1.454.light.4.raw
cgtctagtaccacgaccggtgctcgatttagcacgtgtcgcagggggccctgaggaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtctttgggtccctgatcgcttctctggctccatccttgggaacaaggctgccctcaccatcacgggggcccaggcagatgatgaatctaattatcactgtgcgttgtatatgggttttggcatttcggtgttcggcggagggacccaggtgaccgtcctacgtcagccc

SEQ ID NO: 602325 - DNA, 434 bp, Homo sapiens; identical to SEQ ID NO: 535153
  misc_feature: HIJSMM301EXARB.18.5.A05.1.454.light.4.raw

SEQ ID NO: 602326 - DNA, 484 bp, Homo sapiens; identical to SEQ ID NO: 537878
  misc_feature: HIJSMM301B4KBB.17.34.D01.1.454.light.4.raw

SEQ ID NO: 602327 - DNA, 485 bp, Homo sapiens; identical to SEQ ID NO: 535648
  misc_feature: HIJSMM301EH06Q.17.36.D03.1.454.light.4.raw

SEQ ID NO: 602328 - DNA, 444 bp, Homo sapiens; identical to SEQ ID NO: 535594
  misc_feature: HIJSMM301AGSUE.9.9.A09.1.454.light.4.raw

SEQ ID NO: 602329 - DNA, 486 bp, Homo sapiens
  misc_feature: HIJSMM301ED9IF.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgataactacttagcctggttgcagcacaaacctggccaggctcccaggctcctcatctatgctgcatccatcagggccactggcatcccaggcagattcagtggcagtgggtctgggacagacttcactctcaccatcagcagactggagcctgagattttgcagtctattactgtcagcagtatggtcacgtcccaagaacttttggcctaggggaccaagctggagatacaacgaactgtggctgcaccat

SEQ ID NO: 602330 - DNA, 486 bp, Homo sapiens
  misc_feature: HIJSMM301A410I.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactagaaaatcagcagagtggaggctgaggatgttgggctctattattgcatgcaagctctacaagtcccgctcactttcggcggagggaccgaaggtggagatcaaacgaa

SEQ ID NO: 602331 - DNA, 487 bp, Homo sapiens; identical to SEQ ID NO: 562900
  misc_feature: HIJSMM301EQENH.46.35.D02.1.454.light.4.raw

SEQ ID NO: 602332 - DNA, 504 bp, Homo sapiens
  misc_feature: HIJSMM301A63V9.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatttatggtaagaattaccggccctcagggatcccagaccgaatctctggctccagctcaggaaacacagcttccttgaccatcactggggctcaggcggaagatgaggctgactattactgtagctcccgggacaacagtggtaaccatgtggtattcggcggagggaccaaactgaccgtcctaggtcagcccaaggctgccccctcggtcactctcgttccccg

SEQ ID NO: 602333 - DNA, 485 bp, Homo sapiens; identical to SEQ ID NO: 536040
  misc_feature: HIJSMM301ETS5O.15.1.A01.1.454.light.4.raw

SEQ ID NO: 602334 - DNA, 485 bp, Homo sapiens; identical to SEQ ID NO: 536695
  misc_feature: HIJSMM301DKDJP.10.1.A01.1.454.light.4.raw

SEQ ID NO: 602335 - DNA, 477 bp, Homo sapiens; identical to SEQ ID NO: 537453
  misc_feature: HIJSMM301CWSVD.8.85.H08.1.454.light.4.raw

SEQ ID NO: 602336 - DNA, 483 bp, Homo sapiens
  misc_feature: HIJSMM301C5JLM.41.34.D01.1.454.light.4.raw
tctatactatcacgaccggtgctcgatttagatcgtctgtgttgggtttggggggagtcagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtcccatcaaggtttagcggcagtggatctgggacagaattcactctcacgatcagcggcctgcagcctgatgatgtcgcaacttattactgccaacactatgatagttacccgctcactttcggcggagggaccaaggtggaggtcaagcgaactgtggctgcaca

SEQ ID NO: 602337 - DNA, 483 bp, Homo sapiens
  misc_feature: HIJSMM301DP28F.13.59.F04.1.454.light.4.raw
  modified_base (439)..(439): a, c, t, g, unknown or other
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctactnttttcggcgggacggacgaggtcgcagatacgaacgaactggtg

SEQ ID NO: 602338 - DNA, 496 bp, Homo sapiens
  misc_feature: HIJSMM301C3ZQ6.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttatattgtcagcaatattatattctcctcagacgttcggccaagggaccaaggtggaaatcaaacgaactgtggctgcaccta

SEQ ID NO: 602339 - DNA, 492 bp, Homo sapiens; identical to SEQ ID NO: 573597
  misc_feature: HIJSMM301CQXKX.10.72.G06.1.454.light.4.raw

SEQ ID NO: 602340 - DNA, 497 bp, Homo sapiens; identical to SEQ ID NO: 536371
  misc_feature: HIJSMM301D5SIF.16.78.H01.1.454.light.4.raw

SEQ ID NO: 602341 - DNA, 485 bp, Homo sapiens; identical to SEQ ID NO: 536263
  misc_feature: HIJSMM301EC04H.47.78.H01.1.454.light.4.raw

SEQ ID NO: 602342 - DNA, 476 bp, Homo sapiens; identical to SEQ ID NO: 537368
  misc_feature: HIJSMM301D3Q8F.7.83.H06.1.454.light.4.raw

SEQ ID NO: 602343 - DNA, 512 bp, Homo sapiens; identical to SEQ ID NO: 562621
  misc_feature: HIJSMM301C5XCN.7.34.D01.1.454.light.4.raw

SEQ ID NO: 602344 - DNA, 503 bp, Homo sapiens
  misc_feature: HIJSMM301D31IA.2.76.G10.1.454.light.4.raw
acgctcgacacacgaccggtgctcgatttagtcactcatacaggggggagagatctgggggaagctcagcttcagctgtggtagagaagacaggattcaggacagtctccagcatggccgacttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgacccccaaactcctcatctctcacaataatcagcggccctcaggagtccctgaccgattctctgcctccaagtccggcacctcagcctccctggccatcagtgggctccgggccgaggatgaggctgattattactgtgcaggatgggatgacaacctgggtgcttatctcttcggacctgggaccaaggtcaccgtccttggt

SEQ ID NO: 602345 - DNA, 478 bp, Homo sapiens
  misc_feature: HIJSMM301CDM3U.41.57.F02.1.454.light.4.raw
tctatactatcacgaccggtgctcgatttagctcgatatagttgggtttggggctccaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacagctacaatgttggcaacgaaggagcagcttggctgcagcagtaccagggccaccctcccaaattgctatcatacaggaagaacaaccgcccctcggggatctccgagagattctctgcatcaacgtcaggaaacatagcctccctgaccattactggactccagcctgaggacgaggctgactattactgctcagcatgggacagcagcctcaatgttgggtgttcggcggagggaccaagctgaccgtct

SEQ ID NO: 602346 - DNA, 525 bp, Homo sapiens
  misc_feature: HIJSMM301EB92N.48.27.C05.1.454.light.4.raw
agtatacatacacgaccggtgctcgatttagacgcgatcgaagggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctttgaggacaacaaacgaccctccgggatccctgagagattctctggctccagctcagggacaatggccaccttgactatcaataggggccgacggtggacgatgaggctgactactactgttcctcaacagacagtagtggtgatcgagggcgtgttcggcggagggaccgaagctgaccgtcctaaacgtcacgcccaacggactcgtcccccctccggtccactctcgttccccccg

SEQ ID NO: 602347 - DNA, 484 bp, Homo sapiens
  misc_feature: HIJSMM301CS0UF.26.55.E11.1.454.light.4.raw
agactatactcacgaccggtgctcgatttagcactcgcacgttgggtttgggggcaggagtcagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgcaacctgaggattttgcaacttactactgtcaacagagttacaggcccccctatacttttggccagggaccaagctggagatcacaggaactgtggctgcac

SEQ ID NO: 602348 - DNA, 463 bp, Homo sapiens; identical to SEQ ID NO: 535062
  misc_feature: HIJSMM301ASE5L.11.73.G07.1.454.light.4.raw

SEQ ID NO: 602349 - DNA, 447 bp, Homo sapiens; identical to SEQ ID NO: 535020
  misc_feature: HIJSMM301DO0PU.18.9.A09.1.454.light.4.raw

SEQ ID NO: 602350 - DNA, 507 bp, Homo sapiens; identical to SEQ ID NO: 589398
  misc_feature: HIJSMM301BIN5J.11.57.F02.1.454.light.4.raw

SEQ ID NO: 602351 - DNA, 497 bp, Homo sapiens; identical to SEQ ID NO: 544443
  misc_feature: HIJSMM301DE6YP.51.39.D06.1.454.light.4.raw

SEQ ID NO: 602352 - DNA, 512 bp, Homo sapiens; identical to SEQ ID NO: 552719
  misc_feature: HIJSMM301ERYVD.22.36.D03.1.454.light.4.raw

SEQ ID NO: 602353 - DNA, 510 bp, Homo sapiens
  misc_feature: HIJSMM301BIF1C.9.71.G05.1.454.light.4.raw
tgatacgtctcacgaccggtgctcgatttagtgtcgtcgcaagagagagggggggggtcacaagaggcagcgctctcgggacgtctccaccatggcctgggctctgccccctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctcttttcaagatattcggcggagggaccagggctgaccgtcctgagtcagcccaaggctgccccccg

SEQ ID NO: 602354 - DNA, 501 bp, Homo sapiens; identical to SEQ ID NO: 536142
  misc_feature: HIJSMM301EFIFJ.15.1.A01.1.454.light.4.raw

SEQ ID NO: 602355 - DNA, 497 bp, Homo sapiens
  misc_feature: HIJSMM301DOTH8.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgactgtggctgcaccatctgtcttcatccttcccgccatctgac

SEQ ID NO: 602356 - DNA, 498 bp, Homo sapiens
  misc_feature: HIJSMM301AHJA5.52.38.D05.1.454.light.4.raw
  modified_base (236)..(236): a, c, t, g, unknown or other
cgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgntatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactt

SEQ ID NO: 602357 - DNA, 501 bp, Homo sapiens; identical to SEQ ID NO: 537793
  misc_feature: HIJSMM301CX2Z9.15.37.D04.1.454.light.4.raw

SEQ ID NO: 602358 - DNA, 521 bp, Homo sapiens; identical to SEQ ID NO: 539470
  misc_feature: HIJSMM301DLEUM.27.23.C01.1.454.light.4.raw

SEQ ID NO: 602359 - DNA, 510 bp, Homo sapiens
  misc_feature: HIJSMM301ED0SZ.22.36.D03.1.454.light.4.raw
acatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaacccccccaactcatcatttatggtgtcactcgtcggccctcaggagtctctcatcgcttctcaggctccaagtctggcaacacggcctccctaaccatctctgggctccagtttgaggacgagtctacttatactgcagttcctttaaattaggcgccactctcgtggttttcggcggaggcaccgaagtgaccgtcctcggtcagcccaaggctgccccctggtcact

SEQ ID NO: 602360 - DNA, 523 bp, Homo sapiens
  misc_feature: HIJSMM301A2VC3.12.85.H08.1.454.light.4.raw
atacgacgtacacgaccggtgctcgatttagtatcactcagtcgcggggggggtcgtcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaaccggaaccaatagtgacgttggtcgttataactttgtctcctggtacaaacagcacccaggcaaagccccccaactcctgatttatgaggtcactattcggtcctcaggaatttctaatcgcttctctggttccaagtctggcaacacggcctccctgaccatctctggggtccaggctgaggacgaggctgattatactgcagttcatatacaagcacttccactctcgtggtgttcggcggtgggaccaagctgaccgtcctaagtcagcccaaggctgccccctcggtcactcctgttccctacccc

SEQ ID NO: 602361 - DNA, 503 bp, Homo sapiens; identical to SEQ ID NO: 538884
  misc_feature: HIJSMM301CPLJQ.27.78.H01.1.454.light.4.raw

SEQ ID NO: 602362 - DNA, 522 bp, Homo sapiens
  misc_feature: HIJSMM301AD64B.43.19.B08.1.454.light.4.raw
tgtgagtagtcacgaccggtgctcgatttagtgagtcagtaaggggagtctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccgggggatgaggccgactattactgtcaggtgtgggagtaatggtggtggatcatccggtcttcggtcggagggaccgaacgttgaccgtcctaagtcagcccaaggactgcccctccggtcactctcgttccgtccctccct

SEQ ID NO: 602363 - DNA, 521 bp, Homo sapiens
  misc_feature: HIJSMM301B4H0F.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgctttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctcgtcccgcct

SEQ ID NO: 602364 - DNA, 497 bp, Homo sapiens; identical to SEQ ID NO: 536371
  misc_feature: HIJSMM301EB11J.16.78.H01.1.454.light.4.raw

SEQ ID NO: 602365 - DNA, 500 bp, Homo sapiens; identical to SEQ ID NO: 541228
  misc_feature: HIJSMM301ASOR5.13.11.A11.1.454.light.4.raw

SEQ ID NO: 602366 - DNA, 474 bp, Homo sapiens
  misc_feature: HIJSMM301DC0C5.8.67.G01.1.454.light.4.raw
ctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaattggtatcaacagagcccaggaaaagcccccaaactcctgattttatggtgcatccatttcgcaaagtggggtcccatcaaggttcagtggcagtggatctggggcagatttcaccctcaccatcagcagtctgcaacctgaagactttgcaacttactactgtcagcagtcttacagtaggccgggcacctttggccaggggacgaagctggagatcgaacgaactgtggctgcaccatctgtcttcatcttcccgccatctgagacacgcgag

SEQ ID NO: 602367 - DNA, 475 bp, Homo sapiens
  misc_feature: HIJSMM301C5LVH.13.48.E04.1.454.light.4.raw
tcacgtactacacgaccggtgctcgatttagagagcgtcacagagagaagggggcaggagtcagacccactcaggacaccagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgcaacttattactgtctacaagatcacaattatcctgggacgttcggtccaagggaccaaggtggaaatcaaacgaa

SEQ ID NO: 602368 - DNA, 496 bp, Homo sapiens
  misc_feature: HIJSMM301EQF9A.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagtattttgacaactttactactgtcaacagtacgttaccggtaccccgtactacttttcggccaggggaccaaactggacatacaaacgaactgtgctgcaccatctgtt

SEQ ID NO: 602369 - DNA, 486 bp, Homo sapiens
  misc_feature: HIJSMM301DUKOK.49.81.H04.1.454.light.4.raw
agtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttacttctaccatcatcaacctgcagcctgaggatattgcaacatattactgtcaacaatatgataatctaccactcactttcggcggagggaccacggtggagatcaaacgaactgtggctgcaccatctgttcttcta

SEQ ID NO: 602370 - DNA, 469 bp, Homo sapiens; identical to SEQ ID NO: 545843
  misc_feature: HIJSMM301EU9JZ.7.81.H04.1.454.light.4.raw

SEQ ID NO: 602371 - DNA, 498 bp, Homo sapiens
  misc_feature: HIJSMM301C3VDK.43.49.E05.1.454.light.4.raw
tgtgagtagtcacgaccggtgctcgatttagagcgactagcaacacacaaagggggaagagctgctcagttaggacccagagggaaccatggaaaccccagcgcagcttctcttcctcctgctactctggctcccagataccaccggagaaattgtgttgacgcagtctccaggcaccgtgtctttgtctccaggggaaagagccaccttctcttgcagggccagtcagagtgttagcagcaactacttagcctggtaccagcagaaacctggccaggctcccaggctcctcatctatggtgcatccaccagggccactggcatcccagacagattcagtggcactgggtctgggacagacttcactctcaccatcagcagactggaacctgaagattttgcaatttattactgtcagcagtatgcctggtcgcctccggccctcactttcggcggagggaccaaggtggacgatcaaacgaactgtggctgcaccta

SEQ ID NO: 602372 - DNA, 497 bp, Homo sapiens
  misc_feature: HIJSMM301BOXGG.49.6.A06.1.454.light.4.raw
agtcgagagacacgaccggtgctcgatttagatctactgacaggggggggtctcagaaggcagcgctctcaggacgtcaccaccatggcctggactctgctcctcctcaccctcctcactcagggcacagggtcctgggcccagtctgccctgactcagccgccctccgcgtccgggtctcctggacagtctgtcaccatctcctgcactggaaccagcagtgacgttggtgattataactatgtctcctggtaccaacagtacccaggcaaagcccccagactcatgatttatgcggtcagtaagcggccctcaggggtccctgatcgcttctctggctccaagtctggcaacacggcctccctgaccgtctctgggctccgggctgaagatgaggctgattatttctgcagctcatatgcaggcagcaacaattttgtgatattcggcggagggaccaagctgaccgtcctaggtcagcccaaggctgccccctc

SEQ ID NO: 602373 - DNA, 494 bp, Homo sapiens; identical to SEQ ID NO: 536477
  misc_feature: HIJSMM301CXXV9.22.5.A05.1.454.light.4.raw

SEQ ID NO: 602374 - DNA, 493 bp, Homo sapiens
  misc_feature: HIJSMM301EEPF2.4.59.F04.1.454.light.4.raw
agcactgtagcacgaccggtgctcgatttagtacacacacttagggattgggggaggaactgctcagttaggacccagacggaaccatggaagccccagcgcagcttctcttcctcctgctactctggctcccagataccactggagaaataatattgacgcagtctccagccaccctgtctgtgtctccaggggaaagagccaccctctcctgcagggccagtcagagtgttagcagcaacttagcctggtaccagcagaagcctggccagactcccaggctcctcatctttggtgcattcaccagggccactgatatcccaaccaggttcagcggcagtgggtctgggacagagttcactctcaccatcagcaacctgcagtctgaagattctgcagtttattattgtcaccagtattatagttggcctccgtggacgttcggccaggaccaaggtggaatcaaacgaactgtggctgcaccatctgtctt

SEQ ID NO: 602375 - DNA, 501 bp, Homo sapiens
  misc_feature: HIJSMM301BJNZE.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtctgggtcagccaaggctgccccctcggtca

SEQ ID NO: 602376 - DNA, 496 bp, Homo sapiens
  misc_feature: HIJSMM301C29FV.16.12.B01.1.454.light.4.raw
tgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtgtccgtgtccccaggacagacggccagcatcatctgctctggagataacttgggggataaatatactttctggtatcagcagaaggccggccagtcccctgtattggtcatctttcaagataccgagcggccctcagagatccctgagcgattctctggctccaactctgggaacacagccactctgaccatcagcggggcccagactatggatgaggctgactattactgtcaggcgtgggacagcaattctgttgattttcggcggagggaccaagttgaccgtcctaggtcagccaaggctgccccctcggtcactctcg

SEQ ID NO: 602377 - DNA, 493 bp, Homo sapiens
  misc_feature: HIJSMM301ADGXI.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatccacttttggccaagggaccaagctggagatcaaacgactagtggcgtgtcgaccta

SEQ ID NO: 602378 - DNA, 505 bp, Homo sapiens; identical to SEQ ID NO: 535987
  misc_feature: HIJSMM301EWBMF.18.37.D04.1.454.light.4.raw

SEQ ID NO: 602379 - DNA, 486 bp, Homo sapiens
  misc_feature: HIJSMM301AHPY4.19.71.G05.1.454.light.4.raw
tactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaaggaccgaaggtaggagtat

SEQ ID NO: 602380 - DNA, 499 bp, Homo sapiens
  misc_feature: HIJSMM301CCW1G.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtattacacttatgtcttcggaattgggacacggtcaccgtcctaggtcagcccaaggccaaccccta

SEQ ID NO: 602381 - DNA, 486 bp, Homo sapiens
  misc_feature: HIJSMM301DMPLR.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggctccatctcctgcaggtctagtcagagcgtcctgcatagtagtggatacaactatttggattggtacctgcagaagccaggacagtctccacagctcctgatctatttggcttctaatcgggcctccggggtccctgacaggttcagtggcagtggatcagacacagattttacgactagaaaatcagtagagtggaggctgaggatgttggagtttatactgcatgcaagctctacaactcctctcactttcggcggaggaccaaggtggagaatcaaacgaactgt

SEQ ID NO: 602382 - DNA, 484 bp, Homo sapiens; identical to SEQ ID NO: 535211
  misc_feature: HIJSMM301EIP7K.47.46.E02.1.454.light.4.raw

SEQ ID NO: 602383 - DNA, 509 bp, Homo sapiens
  misc_feature: HIJSMM301C2YE8.16.46.E02.1.454.light.4.raw
tgtactactccacgaccggtgctcgatttagactcatctacagggaaagggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaacccactgtcactctcg

SEQ ID NO: 602384 - DNA, 488 bp, Homo sapiens
  misc_feature: HIJSMM301DBAH0.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggcctgccccctcggtccactcctgttcccaccctcctcgctacgtaga

SEQ ID NO: 602385 - DNA, 507 bp, Homo sapiens
  misc_feature: HIJSMM301ANS63.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggagtatcaaacgaaactgtggctgcaccatctgtctt

SEQ ID NO: 602386 - DNA, 486 bp, Homo sapiens; identical to SEQ ID NO: 535043
  misc_feature: HIJSMM301EVECC.46.35.D02.1.454.light.4.raw

SEQ ID NO: 602387 - DNA, 457 bp, Homo sapiens; identical to SEQ ID NO: 536586
  misc_feature: HIJSMM301A7I6D.49.85.H08.1.454.light.4.raw

SEQ ID NO: 602388 - DNA, 447 bp, Homo sapiens; identical to SEQ ID NO: 535020
  misc_feature: HIJSMM301A77HQ.18.9.A09.1.454.light.4.raw

SEQ ID NO: 602389 - DNA, 508 bp, Homo sapiens; identical to SEQ ID NO: 536388
  misc_feature: HIJSMM301BHMJP.11.57.F02.1.454.light.4.raw

SEQ ID NO: 602390 - DNA, 445 bp, Homo sapiens; identical to SEQ ID NO: 542143
  misc_feature: HIJSMM301ES826.47.85.H08.1.454.light.4.raw

SEQ ID NO: 602391 - DNA, 507 bp, Homo sapiens
  misc_feature: HIJSMM301D2OZE.48.67.G01.1.454.light.4.raw
agtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttccagtgccagtgggtctggggacagacttcactctcaccatcagcagcctagagcccgaagattttgcggtttattacttgtcagcagcgtgccaactggcctctccacgttcggcggagggaccaaggtggacatcaaacgaactgtggctgcaccatctgtcttcatcttcccg

SEQ ID NO: 602392 - DNA, 499 bp, Homo sapiens
  misc_feature: HIJSMM301EUBNK.22.27.C05.1.454.light.4.raw
acatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattacgggttcagcaatattatattcctcctcagacgttcggccaagggaccaaggtggaaatcaaacgaactgtggctgcac

SEQ ID NO: 602393 - DNA, 444 bp, Homo sapiens; identical to SEQ ID NO: 534993
  misc_feature: HIJSMM301DFS5P.5.9.A09.1.454.light.4.raw

SEQ ID NO: 602394 - DNA, 512 bp, Homo sapiens; identical to SEQ ID NO: 556539
  misc_feature: HIJSMM301AT4QH.5.58.F03.1.454.light.4.raw

SEQ ID NO: 602395 - DNA, 495 bp, Homo sapiens
  misc_feature: HIJSMM301DWLO2.22.9.A09.1.454.light.4.raw
acatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtgggtctggaagagacttcactctcaccatcaacagcctagagcctgacgattctgcagtttattactgtcagcagcgtaccaagtggcctccgactttggccagggggccaagctggagatcagacgaactgtggctgcaccatctgtcttcatcttcccg

SEQ ID NO: 602396 - DNA, 476 bp, Homo sapiens
  misc_feature: HIJSMM301E23DU.13.5.A05.1.454.light.4.raw
tcacgtactacacgaccggtgctcgatttagatagatagacagggggctgggcctcaggaggcagcatcggaggtgcctcagccatggcatggatccctctcttcctcggcgtccttgcttactgcacagaatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggactgggaccaaggtcaccgtcctaagtcagaccccg

SEQ ID NO: 602397 - DNA, 502 bp, Homo sapiens; identical to SEQ ID NO: 536253
  misc_feature: HIJSMM301BTU6L.21.22.B11.1.454.light.4.raw

SEQ ID NO: 602398 - DNA, 494 bp, Homo sapiens; identical to SEQ ID NO: 535276
  misc_feature: HIJSMM301ASX34.16.6.A06.1.454.light.4.raw

SEQ ID NO: 602399 - DNA, 520 bp, Homo sapiens; identical to SEQ ID NO: 541666
  misc_feature: HIJSMM301EO7K4.41.19.B08.1.454.light.4.raw

SEQ ID NO: 602400 - DNA, 495 bp, Homo sapiens; identical to SEQ ID NO: 538269
  misc_feature: HIJSMM301CAOZ4.9.1.A01.1.454.light.4.raw

SEQ ID NO: 602401 - DNA, 490 bp, Homo sapiens; identical to SEQ ID NO: 541407
  misc_feature: HIJSMM301AHOHO.14.55.E11.1.454.light.4.raw

SEQ ID NO: 602402 - DNA, 491 bp, Homo sapiens
  misc_feature: HIJSMM301CKI7U.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcaccccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggccaggggaccaaactggatatcagacgaactgtggctgca

SEQ ID NO: 602403 - DNA, 524 bp, Homo sapiens
  misc_feature: HIJSMM301BQ4FE.5.27.C05.1.454.light.4.raw
atcagacacgcacgaccggtgctcgatttagacgcgatcgaagggtttgggggtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatggaggccgactattactgtcaggtgtggaatggtgattatgattatgtcttcggaactgggaccaaggtcaccgtcctaggtcagcccaaggccaaccccactgtcactctgttcccgccctcctccgtcgtt

SEQ ID NO: 602404 - DNA, 478 bp, Homo sapiens
  misc_feature: HIJSMM301BJCDY.17.34.D01.1.454.light.4.raw
cgtagactagcacgaccggtgctcgatttagatcgtctgtgttgggtttgggtcatcacaatatctgcactggatacctggatccagtgcagatattgtgatgacccagactccactctctctgtccgtcacacctggacagccggcctccatctcctgcaagtctagtcagagcctcctgcatagtgatggaaagacctatttgtattggtacctgcagaagccaggccagcctccacaggtcctgatctatgaagtttccaaccggttctctggagtgccagataggttcagtggcagcgggtcagggacagatttcacactgaaaatcagccgggtggaggctgaggatgttggggtttattactgcatgcaaagtatacagcttccgtacacttttggccaggggaccaagctggagatcaaacgaactgtggctgcaccatctgtcttcatcttcccgccatctgactagtct

SEQ ID NO: 602405 - DNA, 463 bp, Homo sapiens; identical to SEQ ID NO: 543051
  misc_feature: HIJSMM301BD0S6.26.78.H01.1.454.light.4.raw

SEQ ID NO: 602406 - DNA, 503 bp, Homo sapiens
  misc_feature: HIJSMM301DHRPR.22.27.C05.1.454.light.4.raw
acatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctcctcagacgttcggccaagggaccaaggtaggaaatacaaacgaaactgtggctgcaccca

SEQ ID NO: 602407 - DNA, 492 bp, Homo sapiens; identical to SEQ ID NO: 563294
  misc_feature: HIJSMM301D67AW.49.34.D01.1.454.light.4.raw

SEQ ID NO: 602408 - DNA, 488 bp, Homo sapiens; identical to SEQ ID NO: 535990
  misc_feature: HIJSMM301AIPW7.11.28.C06.1.454.light.4.raw

SEQ ID NO: 602409 - DNA, 490 bp, Homo sapiens; identical to SEQ ID NO: 540941
  misc_feature: HIJSMM301D2MYQ.16.72.G06.1.454.light.4.raw

SEQ ID NO: 602410 - DNA, 486 bp, Homo sapiens; identical to SEQ ID NO: 535917
  misc_feature: HIJSMM301CDY4F.3.10.A10.1.454.light.4.raw

SEQ ID NO: 602411 - DNA, 519 bp, Homo sapiens
  misc_feature: HIJSMM301C0ZSY.41.19.B08.1.454.light.4.raw
tctatactatcacgaccggtgctcgatttagtgagtcagtaagggcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccc

SEQ ID NO: 602412 - DNA, 521 bp, Homo sapiens; identical to SEQ ID NO: 538715
  misc_feature: HIJSMM301EBE58.27.23.C01.1.454.light.4.raw

SEQ ID NO: 602413 - DNA, 516 bp, Homo sapiens; identical to SEQ ID NO: 559221
  misc_feature: HIJSMM301CHOQX.9.14.B03.1.454.light.4.raw

SEQ ID NO: 602414 - DNA, 496 bp, Homo sapiens
  misc_feature: HIJSMM301B9KT5.48.39.D06.1.454.light.4.raw
agtatacatacacgaccggtgctcgatttagtgacatctcgcagttctttggggagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagagttaaccgaactgtggctgcaccatctgtctt

SEQ ID NO: 602415 - DNA, 493 bp, Homo sapiens; identical to SEQ ID NO: 539456
  misc_feature: HIJSMM301AX1JH.10.79.H02.1.454.light.4.raw

SEQ ID NO: 602416 - DNA, 487 bp, Homo sapiens; identical to SEQ ID NO: 557055
  misc_feature: HIJSMM301CYJTA.17.34.D01.1.454.light.4.raw

SEQ ID NO: 602417 - DNA, 512 bp, Homo sapiens; identical to SEQ ID NO: 562562
  misc_feature: HIJSMM301ENS74.51.27.C05.1.454.light.4.raw

SEQ ID NO: 602418 - DNA, 503 bp, Homo sapiens; identical to SEQ ID NO: 568855
  misc_feature: HIJSMM301AQM2C.9.71.G05.1.454.light.4.raw

SEQ ID NO: 602419 - DNA, 507 bp, Homo sapiens
  misc_feature: HIJSMM301DWPT5.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagatttgcagtttattactgtcaacagcgtagcagcaggcctccggcgacgttcggccaagggaccaaggtggaagtcaagcgaactgtggctgcaccatctgtcttcatcttcccgcc

SEQ ID NO: 602420 - DNA, 493 bp, Homo sapiens
  misc_feature: HIJSMM301A87IY.12.23.C01.1.454.light.4.raw
atacgacgtacacgaccggtgctcgatttagtacacgtgattagggattgggggaggaactgctcagttaggacccagacggaaccatggaagccccagcacagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcagcagtataataactggttcctgctcactttcggcgggggaccgaaggtggagatcaaacgaactgtggctgcaccatctgt

SEQ ID NO: 602421 - DNA, 496 bp, Homo sapiens
  misc_feature: HIJSMM301A60XE.51.29.C07.1.454.light.4.raw
cgatcgtatacacgaccggtgctcgatttagagtgctacgaagggaaaggggtgatcaggactcctcagttcaccttctcacaatgaggctccctgctcagctcctggggctgctaatgctctgggtctctggatccagtggggatattgtcatgactcagtctccactctccctgcccgtcacccctggagagccggcctccatctcctgcaggtctagtcagagcctcctccataatagtggattcttctatttggattggtacgtgctgaagccagggcagtctccacaactcctgatctatttgcgttctaatcgggcctccggggtccctgacaggttcagtggcagtggatcaggcacagattttacactgacaatcaacagagtggaggctgaggatgttggggtttattactgcgtgcaaagtctgcaaactatcaccttcggccaagggacgacgactaggagattaaacgaactgtggctgcacca

SEQ ID NO: 602422 - DNA, 490 bp, Homo sapiens; identical to SEQ ID NO: 535234
  misc_feature: HIJSMM301CDMV0.17.21.B10.1.454.light.4.raw

SEQ ID NO: 602423 - DNA, 504 bp, Homo sapiens
  misc_feature: HIJSMM301EZL6P.40.34.D01.1.454.light.4.raw
tctagcgactcacgaccggtgctcgatttagatcgtctgtgttgggtttggggggtagctcaggaagcagagcctggagcatctccactatggcctgggctccactacttctcaccctcctcgctcactgcacaggttcttgggccaattttatgctgactcagccccactctgtgtcggggtctccggggaagacggtaaccatctcctgcacccgcagtagtggcagcattgccagcaactatgtgcagtggtaccagcagcgcccgggcagttcccccaccactttaatctatgaggataacaaaagactctctggggtccctgatcggttctctggctccatcgacagctcctccaattctgcctccctcaccatctctggactgaagactgaggacgaggctgattattactgtcagagttatgatgacaccaattactgggtgttcggcggagggaccaagctgaccgtcctaggtcagcccaaggctgccccctggt

SEQ ID NO: 602424 - DNA, 481 bp, Homo sapiens; identical to SEQ ID NO: 535993
  misc_feature: HIJSMM301AI81E.21.25.C03.1.454.light.4.raw

SEQ ID NO: 602425 - DNA, 415 bp, Homo sapiens
  misc_feature: HIJSMM301BXM42.16.46.E02.1.454.light.4.raw
tgtactactccacgaccggtgctcgatttagactcatctacagggaaagggggctgtgcctggggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaaccccactgtcactctgttcccgccctcccgagtagtaca

SEQ ID NO: 602426 - DNA, 487 bp, Homo sapiens
  misc_feature: HIJSMM301C8NI3.46.26.C04.1.454.light.4.raw
actagcagtacacgaccggtgctcgatttagtctagcgactttgggtttggggtggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctcgcagaagccagggcagtctccacagctcatcatctatttgggttctaatcgggcctccggggtccctgacaggttcagtggcagtggatcaggcacagattttacactgaaaatcagcagagtggaggctgaggatgttgggctcgtattattgcatgcaagctctacaagtcccgctcactttcggcggagggaccaaggtggagatcaaacgaa

SEQ ID NO: 602427 - DNA, 521 bp, Homo sapiens; identical to SEQ ID NO: 539470
  misc_feature: HIJSMM301A13P0.27.23.C01.1.454.light.4.raw

SEQ ID NO: 602428 - DNA, 454 bp, Homo sapiens; identical to SEQ ID NO: 534964
  misc_feature: HIJSMM301C9I9M.19.86.H09.1.454.light.4.raw

SEQ ID NO: 602429 - DNA, 494 bp, Homo sapiens; identical to SEQ ID NO: 534994
  misc_feature: HIJSMM301DFCPX.27.78.H01.1.454.light.4.raw

SEQ ID NO: 602430 - DNA, 465 bp, Homo sapiens; identical to SEQ ID NO: 538589
  misc_feature: HIJSMM301AJ1NM.12.39.D06.1.454.light.4.raw

SEQ ID NO: 602431 - DNA, 501 bp, Homo sapiens
  misc_feature: HIJSMM301D79QP.52.78.H01.1.454.light.4.raw
cgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcggagggaccaagctgaccgtcctaggtcagcccaaggctgccccctcggtcactcg

SEQ ID NO: 602432 - DNA, 505 bp, Homo sapiens; identical to SEQ ID NO: 546621
  misc_feature: HIJSMM301DQWIJ.15.86.H09.1.454.light.4.raw

SEQ ID NO: 602433 - DNA, 492 bp, Homo sapiens
  misc_feature: HIJSMM301BEO1X.14.28.C06.1.454.light.4.raw
cgtctagtaccacgaccggtgctcgatttagagctcacgtattgggtttgggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggtagggaccaaggtggaggtcaaacgaactgtggctgcaccatctgtcttcta

SEQ ID NO: 602434 - DNA, 480 bp, Homo sapiens
  misc_feature: HIJSMM301AZYQZ.41.68.G02.1.454.light.4.raw
tctatactatcacgaccggtgctcgatttagtcgatagtgaagggaaagggggcaggagtcagtcccaaccaggacacagcatggacatgagggtccctgctcagctcctggggctcctgctgctctggctctcaggtgccagatgtgacatccagatgacccagtctccaacctccctgtctgcatctgtaggagacagagtcaccatcacttgccaggccagtcaggacattagcaactatttaaattggtatcagcagaaaccagggaaagcccctaagctcctgatctacgatgcatccaatttggaatcaggggtcccatcaaggttcagtggaagtggatctgggacagattttactttcaccatcaccagcctgcagcctgaagatattgcaacatattactgtcaacagtatgataatctccctcccactttcggcggagggaccgaaggtggagatcaaacgaactagtgg

SEQ ID NO: 602435 - DNA, 486 bp, Homo sapiens
  misc_feature: HIJSMM301BCFT8.5.40.D07.1.454.light.4.raw
atcagacacgcacgaccggtgctcgatttagtgatagagcgtaacaacagagggggaggaactgctcagttaggacccagacggaaccatggaagccccagcgcagcttctcttcctcctgctactctggctcccagataccattggagagatagtgatgacgcagtctccagccaccctgtctgtgtctccaggggaaagagccaccctctcctgcagggccagccagagtgtaagtagtaggttagcctggtatcagcagaaacctggccaggctcccaggctcctcatctatggtgcatctaccagggccactggtatcccagccaggttcagtggcagtgggtctgggacagagttcactctcaccatcagcagcctgcagtctgaagattttgcaacttacttttgtcaacaggctcagagtttcccgctcactttcggcggagggaccaaggtggagatcaaacgaactgtggctgcacc

SEQ ID NO: 602436 - DNA, 494 bp, Homo sapiens; identical to SEQ ID NO: 534992
  misc_feature: HIJSMM301EEQPX.9.1.A01.1.454.light.4.raw

SEQ ID NO: 602437 - DNA, 487 bp, Homo sapiens; identical to SEQ ID NO: 537079
  misc_feature: HIJSMM301ASIEB.14.55.E11.1.454.light.4.raw

SEQ ID NO: 602438 - DNA, 484 bp, Homo sapiens
  misc_feature: HIJSMM301EQ3XF.48.85.H08.1.454.light.4.raw
agtatacatacacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacaatcacctgcactgggaacaacaataatgtcgccaaccaaggagcagcttggctgcagcagcaccagggccaccctcccaaagtcgtatccgacagggataacaatcggcccttagggatctcagagagaatatctgcatccaggtcaggaaacacagcctccctgaccattactggactccaacctgaggacgaggctgactattattgctcagcatgggacaccagcctcaatgccgcggtattcggcgcagggaccaagctgaccgtcctaggtcacgg

SEQ ID NO: 602439 - DNA, 484 bp, Homo sapiens
  misc_feature: HIJSMM301BCYTD.5.16.B05.1.454.light.4.raw
atcagacacgcacgaccggtgctcgatttagagctcacgtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaagattcagtggcagtggatctgggacagatttcactctcaccatcagtagtctacaacctgaagattttgcaacttactactgtcaacagagttacgatacccctcgctcactttcggcggagggaccaaggtggagatcaaacgaactgtggctgcaccatctgtt

SEQ ID NO: 602440 - DNA, 490 bp, Homo sapiens; identical to SEQ ID NO: 574852
  misc_feature: HIJSMM301ES64B.14.55.E11.1.454.light.4.raw

SEQ ID NO: 602441 - DNA, 478 bp, Homo sapiens
  misc_feature: HIJSMM301CP78B.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggaggatcagacgaactgtgg

SEQ ID NO: 602442 - DNA, 507 bp, Homo sapiens
  misc_feature: HIJSMM301B38DL.22.46.E02.1.454.light.4.raw
  modified_base (415)..(415): a, c, t, g, unknown or other
acatacgcgtcacgaccggtgctcgatttagactcatctacagggaaaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtccgtcaccatctcctgcactgggaccagcagtgatgttggtgcttataactatgtctcctggtaccagcaccacccaggcaaagccccccaactcttaatttttggtgtcaataaccgcccctcaggggtccctgatcgcttctccggctccaagtctggcaacacggcctccctgaccatctctggactccaggctgacgatgagggtgacttttacngctgctcatatgcaggcaactataatatggtcttcggcggagggaccaaagtgaccgtcctaggtcagcccaaggctgccccctcggtcact

SEQ ID NO: 602443 - DNA, 491 bp, Homo sapiens; identical to SEQ ID NO: 547053
  misc_feature: HIJSMM301CIXZK.3.33.C11.1.454.light.4.raw

SEQ ID NO: 602444 - DNA, 518 bp, Homo sapiens
  misc_feature: HIJSMM301CZ9J6.8.38.D05.1.454.light.4.raw
ctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctggggacagacttcactctcaccatcagcagcctagagcctgaagattttgcagtttattactgtcaacatcgtaccgagtggcctccgggggccactttcggcctcggaccgaaatagtagatacaaacgaaacgtagtggctgcaccactctcgtcttctatcttcccgt

SEQ ID NO: 602445 - DNA, 494 bp, Homo sapiens; identical to SEQ ID NO: 534994
  misc_feature: HIJSMM301A5OQK.27.78.H01.1.454.light.4.raw

SEQ ID NO: 602446 - DNA, 491 bp, Homo sapiens
  misc_feature: HIJSMM301CVHWO.4.43.D10.1.454.light.4.raw
agcactgtagcacgaccggtgctcgatttagactagcagtaaggggggagtcagtctcagtcaggacacagcatggacatgagggtccccgctcagctcctggggctcctgctactctggctccgaggtggcagatgtgacatccagatgacccagtctccatcctccctgtctgcatctgtaggggacagcgtcaccatcacttgccggacaagtcagagcattaaccggtatttaaattggtatcagcaaaaaccaggggaagcccctaaactcctgatctatgctgcatccactttgcacagtggggtcccatcgaggttcagtggcagtggagctgggacagatttcactctcaccatcagcagtctgcaacctgaagattttgcaacttacttctgtcaacagagttacagttcccggacgttcggccgaaggaccgaaacgtaggaaagtacatacgaactacgtggctgcaccatactgtcttc

SEQ ID NO: 602447 - DNA, 495 bp, Homo sapiens
  misc_feature: HIJSMM301DE18Z.51.76.G10.1.454.light.4.raw
cgatcgtatacacgaccggtgctcgatttagtcactcatacaggggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggcctctgagaatatagatatctacttggtctggtaccagcaaaaacctggccagcctcccaggctcctcgtccatagtgcctccgccagggccgctggtgtcccagccaggttccgaggcagtcggtctgggacagagttcactctcaccattaccaacctgcagtctgaagattttggactttattactgtcagcagtataatgactggcctaggacgttcggccaagggaccaggtggaaatcaagcgaactgtggctgcaccatctgtcttcatcttcccgccat

SEQ ID NO: 602448 - DNA, 486 bp, Homo sapiens
  misc_feature: HIJSMM301D8AW8.12.8.A08.1.454.light.4.raw
atacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccagcatcacctgctctggagatgtattgactaatgagtatgcttcctggtatcagcagaaggcaggccagccccctgtcctactcatctttcaaaataccaggcggccctctggggtccctgagcgattctctggctccgactctgggaacacagtcactctgaccatcagcgggacccaggctattgatgaggctgtctactactgtcaggcgtgggacagcagcgtggtgttcggcggagggaccagtctgaccgtcttaggtcagcccaaggctcgccccctcggtctac

SEQ ID NO: 602449 - DNA, 488 bp, Homo sapiens; identical to SEQ ID NO: 535990
  misc_feature: HIJSMM301D2R9N.11.28.C06.1.454.light.4.raw

SEQ ID NO: 602450 - DNA, 490 bp, Homo sapiens
  misc_feature: HIJSMM301CHM71.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatacgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggtacgttcggccaagggaccaaggtggatatcagacgaa

SEQ ID NO: 602451 - DNA, 499 bp, Homo sapiens
  misc_feature: HIJSMM301EDH9N.48.10.A10.1.454.light.4.raw
agtatacatacacgaccggtgctcgatttagcgtcgatctcagggggcaggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggtccaaggaccgacgggtggaaagtacaaacgaaacctaagtggcgtcggcacccaatcttcg

SEQ ID NO: 602452 - DNA, 505 bp, Homo sapiens
  misc_feature: HIJSMM301AQ7WP.40.28.C06.1.454.light.4.raw
tctagcgactcacgaccggtgctcgatttagagctcacgtattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtgggtctgggacagccttcactctcaccatcagcagcctggagcccgaagattttgcggtttattactgtcagcagcgtgccgactggcccctcacgttcggcggagggaccaaggtggacatcaaacgaactgtggctgcaccatctgtcttcatcttcccgcc

SEQ ID NO: 602453 - DNA, 478 bp, Homo sapiens
  misc_feature: HIJSMM301EMXGE.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtcgcctacgttttgggcgggggaccaagggtgacatacaaacgaact

SEQ ID NO: 602454 - DNA, 493 bp, Homo sapiens
  misc_feature: HIJSMM301E3OJX.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattaactgccaacagtatcatcatcattgtaatttcggtggagggaccaaggtggaaggtcaaacgaactgtggctgcaccatctgtcttcatt

SEQ ID NO: 602455 - DNA, 434 bp, Homo sapiens
  misc_feature: HIJSMM301CNYDO.18.5.A05.1.454.light.4.raw
tacgagtatgcacgaccggtgctcgatttagatagatagacagggtggaaggagactgggacatccagatgacccagtctccttccaccctgtctgcatctgtaggagacagagtcaccatctcttgccgggccactcagagtattagtatctggttggcctggtatcagcagaaaccagggaaagcccctaagctcctgatcgagaaggcgtctagtttagaaagtggggtcccatcaaggtttagcggcagtggatctgggacagaattcactctcaccatcagcagcctgcagcctgatgattttgcaacttattactgccaacattataatacttattcgtacacttttggccaggggaccaagctggagatcaaacgaactgtggctgcaccatctgtcttcatcttctcgccatctgacatactcgta

SEQ ID NO: 602456 - DNA, 504 bp, Homo sapiens; identical to SEQ ID NO: 538013
  misc_feature: HIJSMM301BSFRA.9.12.B01.1.454.light.4.raw

SEQ ID NO: 602457 - DNA, 500 bp, Homo sapiens
  misc_feature: HIJSMM301B48MN.40.42.D09.1.454.light.4.raw
tctagcgactcacgaccggtgctcgatttagacacatacgcagggaaagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagaagcattgccaaaaaaatatgcttattggtaccaacagaagtcaggccaggcccctgtgctggtcatctatgaggacaacaaacgaccctccgagatccctgagagattctctggctccagctcagggacaatggccaccttggctctcagtggggcccaggtggaggatgaagctgactactactgttactcagtggacagcagtggaaatcatgggtattcggcggagggaccaagctgaccgtcctaggtcagcccaaggctgccccctcggtctac

SEQ ID NO: 602458 - DNA, 494 bp, Homo sapiens
  misc_feature: HIJSMM301C56NQ.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggtattttgactaacttactactgtacagcaggtctaacgaggctcgaccccctaaccttccggaccgagggacacgactaggagaattaaacgaacgtggtggctgccac

SEQ ID NO: 602459 - DNA, 522 bp, Homo sapiens; identical to SEQ ID NO: 538091
  misc_feature: HIJSMM301AGEOX.27.23.C01.1.454.light.4.raw

SEQ ID NO: 602460 - DNA, 494 bp, Homo sapiens; identical to SEQ ID NO: 534994
  misc_feature: HIJSMM301AX4KJ.27.78.H01.1.454.light.4.raw

SEQ ID NO: 602461 - DNA, 492 bp, Homo sapiens
  misc_feature: HIJSMM301CIMR5.53.11.A11.1.454.light.4.raw
cgcgtatacacacgaccggtgctcgatttagctacgactgcagggggctgtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaacaatatggatattggtaccggcagaagccaggccaggcccctgtgttggtaatatataaagacagggagaggccccagggatccctgagcgatactctggctccagctcagggacaacagtcacattgaccatcagtggagtccaggcagaagacgaggctgactattactgtcaatctgcggacagcagtggttctcatgtggtattcggcggagggaccaaggctgacgtcctaggtcagcccaaggctgccccctggtcac

SEQ ID NO: 602462 - DNA, 484 bp, Homo sapiens; identical to SEQ ID NO: 540581
  misc_feature: HIJSMM301D1YRZ.3.88.H11.1.454.light.4.raw

SEQ ID NO: 602463 - DNA, 513 bp, Homo sapiens
  misc_feature: HIJSMM301A5YN6.22.36.D03.1.454.light.4.raw
acatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaacccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaattaggcgccactctcgtgttttcggcggaggcaccgaagtgaccgtcctcggtcagcccaaggctcgccccctcggtcact

SEQ ID NO: 602464 - DNA, 502 bp, Homo sapiens; identical to SEQ ID NO: 570546
  misc_feature: HIJSMM301DZ97B.15.59.F04.1.454.light.4.raw

SEQ ID NO: 602465 - DNA, 485 bp, Homo sapiens; identical to SEQ ID NO: 536263
  misc_feature: HIJSMM301E0WOU.47.78.H01.1.454.light.4.raw

SEQ ID NO: 602466 - DNA, 486 bp, Homo sapiens
  misc_feature: HIJSMM301E25SO.2.1.A01.1.454.light.4.raw
acgctcgacacacgaccggtgctcgatttagacgtctcatcagggcctgggctctgctattcctcaccctcctcactcagggcacagggtcctgggcccagtctgccctgactcagcctgcctccgtgtctgggtctcctagacagacgctcaacatttcctgcactggaaccagcagtgacgttggtggttatgattctgtctcctggtaccaacaacacccggccagagcccccaaactcttaatttatgatgtcagaaatcggccctcaggggcttctactcgcttctctggctccaagtctggcaacacggcctccctgaccatctcttgggtccaggctgaggacgaggctatatattattgcagttcatatacaagcagtagcacggtggtcttcggcggagggaccaagctgaccgtcctaggtcagcccaaggctcgccccctcggtcactttcgtcccgccctcctctgtcgagcgt

SEQ ID NO: 602467 - DNA, 495 bp, Homo sapiens; identical to SEQ ID NO: 535007
  misc_feature: HIJSMM301AYUIL.22.5.A05.1.454.light.4.raw

SEQ ID NO: 602468 - DNA, 487 bp, Homo sapiens; identical to SEQ ID NO: 550363
  misc_feature: HIJSMM301CNL7U.19.71.G05.1.454.light.4.raw

SEQ ID NO: 602469 - DNA, 465 bp, Homo sapiens
  misc_feature: HIJSMM301E0YG2.11.70.G04.1.454.light.4.raw
cgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgttgcaacttattactgtcaaaagaatagcgctgccccgctcagtttcggcggagggaccaaggtgagatac

SEQ ID NO: 602470 - DNA, 486 bp, Homo sapiens; identical to SEQ ID NO: 535043
  misc_feature: HIJSMM301CDX1B.46.35.D02.1.454.light.4.raw

SEQ ID NO: 602471 - DNA, 487 bp, Homo sapiens; identical to SEQ ID NO: 535583
  misc_feature: HIJSMM301BDKN7.22.73.G07.1.454.light.4.raw

SEQ ID NO: 602472 - DNA, 464 bp, Homo sapiens
  misc_feature: HIJSMM301EMZFX.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaaatttggaaacagaggtcccaccgaggttcagtggaagtggatctgggacagactttactctcaccatcagcagcctgcagcctgaagatattgcaacatattactgtcaacagtatgatcgtctcctcaatttcggccctgggaccagagtggacatgaaacgaa

SEQ ID NO: 602473 - DNA, 494 bp, Homo sapiens
  misc_feature: HIJSMM301BVT8K.19.57.F02.1.454.light.4.raw
tactctcgtgcacgaccggtgctcgatttagctcgatatagttgggtttggggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgctaacttatttttgtcaacaggctaacactttccccctcacctttcggcggagggaccaaggtggagatcaagcgaactgtggctgcaccatctgtctt

SEQ ID NO: 602474 - DNA, 484 bp, Homo sapiens
  misc_feature: HIJSMM301CZZ4K.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggtctgttcggtcggcgggaccg

SEQ ID NO: 602475 - DNA, 447 bp, Homo sapiens; identical to SEQ ID NO: 535201
  misc_feature: HIJSMM301DJXN9.18.9.A09.1.454.light.4.raw

SEQ ID NO: 602476 - DNA, 518 bp, Homo sapiens
  misc_feature: HIJSMM301BITGT.12.71.G05.1.454.light.4.raw
  modified_base (507)..(507): a, c, t, g, unknown or other
atacgacgtacacgaccggtgctcgatttagtgtcgtcgcaagagagagggggagtgaggagcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgatttttggaaatttttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagcccaaggctgccccctcggtcactcngttcccaccct

SEQ ID NO: 602477 - DNA, 492 bp, Homo sapiens
  misc_feature: HIJSMM301EL8FE.52.33.C11.1.454.light.4.raw
cgcagtacgacacgaccggtgctcgatttagagtgagctcgttgggtttggggtggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacgtatccctgatcgcttctcaggctccggctctgggactgagcgctacctcaccatctccagcctccagtctgaggacgagggtgactattactgtcagacgtgggacactggcattttggggtgttcgggcggagggaccaaggttgaccgtcctaggtcagcccaaggctgccccctggtcac

SEQ ID NO: 602478 - DNA, 500 bp, Homo sapiens; identical to SEQ ID NO: 541228
  misc_feature: HIJSMM301EK7UY.13.11.A11.1.454.light.4.raw

SEQ ID NO: 602479 - DNA, 441 bp, Homo sapiens; identical to SEQ ID NO: 534971
  misc_feature: HIJSMM301CB1O2.11.3.A03.1.454.light.4.raw

SEQ ID NO: 602480 - DNA, 506 bp, Homo sapiens; identical to SEQ ID NO: 537290
  misc_feature: HIJSMM301ARUJT.13.11.A11.1.454.light.4.raw

SEQ ID NO: 602481 - DNA, 469 bp, Homo sapiens; identical to SEQ ID NO: 545843
  misc_feature: HIJSMM301EC3US.7.81.H04.1.454.light.4.raw

SEQ ID NO: 602482 - DNA, 488 bp, Homo sapiens
  misc_feature: HIJSMM301EMOGT.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggtttagtggcagtgcgtctgcgacagagttcactctcaccatcaacagcctgcagtctgaagattttgctagtttattactgtcagcagtatcatgactggccgctcaccttcggccaagggacacgactggagattaacgaactgtggctgcaccatctgt

SEQ ID NO: 602483 - DNA, 488 bp, Homo sapiens; identical to SEQ ID NO: 535725
  misc_feature: HIJSMM301A7A5Y.12.88.H11.1.454.light.4.raw

SEQ ID NO: 602484 - DNA, 512 bp, Homo sapiens
  misc_feature: HIJSMM301DZR1G.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtacacttttggccaggggacccagggtggagatcagactgatattaacagcgaaaagagtattttgttaagggaagtaatgaagttaac

SEQ ID NO: 602485 - DNA, 500 bp, Homo sapiens
  misc_feature: HIJSMM301CL2MG.9.53.E09.1.454.light.4.raw
tgatacgtctcacgaccggtgctcgatttagagagagtgtgttgggtttgggggctggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaagggtgaccggtcctagggtcaggcccaagg

SEQ ID NO: 602486 - DNA, 471 bp, Homo sapiens
  misc_feature: HIJSMM301D1N6W.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctggctccaggctgacgatgaggctgattattattgccagtcctatgacacaccctgcgtgttttgctgtcgcggcgg

SEQ ID NO: 602487 - DNA, 480 bp, Homo sapiens
  misc_feature: HIJSMM301B0CAM.5.73.G07.1.454.light.4.raw
atcagacacgcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccgccctgtctgtgtctccaggggaaagagcctccctctcgtgcagggccagtcagagtgttagaatcaacttagcctggtaccagcagaaacctggccagcctcccaggcccctcatctatgctgcatccgccagggccactggtatcccagccaggttcagtggcagtgggtctgggacagacttcactctcaccatcagcagcctgcagtctgaagattttgcagtttattactgtcagcagtatgatgactggcctcagacgttcggccaagggaccaaggtggaagtcaaacgaactagtggctgcaccat

SEQ ID NO: 602488 - DNA, 378 bp, Homo sapiens; identical to SEQ ID NO: 547290
  misc_feature: HIJSMM301A2JSC.40.9.A09.1.454.light.4.raw

SEQ ID NO: 602489 - DNA, 498 bp, Homo sapiens
  misc_feature: HIJSMM301D4VMP.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggcccaacccca

SEQ ID NO: 602490 - DNA, 513 bp, Homo sapiens; identical to SEQ ID NO: 558032
  misc_feature: HIJSMM301A8TE1.16.66.F11.1.454.light.4.raw

SEQ ID NO: 602491 - DNA, 500 bp, Homo sapiens; identical to SEQ ID NO: 592824
  misc_feature: HIJSMM301BEA77.14.59.F04.1.454.light.4.raw

SEQ ID NO: 602492 - DNA, 502 bp, Homo sapiens; identical to SEQ ID NO: 566373
  misc_feature: HIJSMM301C97TJ.21.38.D05.1.454.light.4.raw

SEQ ID NO: 602493 - DNA, 480 bp, Homo sapiens; identical to SEQ ID NO: 537854
  misc_feature: HIJSMM301B8JW5.41.17.B06.1.454.light.4.raw

SEQ ID NO: 602494 - DNA, 518 bp, Homo sapiens; identical to SEQ ID NO: 543507
  misc_feature: HIJSMM301CSBV2.19.80.H03.1.454.light.4.raw

SEQ ID NO: 602495 - DNA, 500 bp, Homo sapiens; identical to SEQ ID NO: 542669
  misc_feature: HIJSMM301ERLXG.18.11.A11.1.454.light.4.raw

SEQ ID NO: 602496 - DNA, 490 bp, Homo sapiens
  misc_feature: HIJSMM301DOZ2Y.40.20.B09.1.454.light.4.raw
  modified_base (433)..(433): a, c, t, g, unknown or other
tctagcgactcacgaccggtgctcgatttagtgtagtgtgaaggggggcctcaggaagccgcatcggaggtgcctcagccatggcatggatccctctcttcctcggcgtccttgcttactgcacaggatccgtggcctcctctgagttgactcagccaccctcagtgtccgtgtccccggacagacagccagcatcacgtgctcaggagatgatttgaacaataaacatgcttgttggtatcaacagaaaccaggccagtcccctgttctggtcatctttgaggattcaaaagcggccctcagggatccctgagcgattctctggctccaaagtctgcgctcaacagccactctgaccatcagcgggacccagcctatggatgaggcttgactattaattgtcagtcgtgggacagcagcacctcttctaatntcttcggaactgggacccaggtcaccgtcctccgtcagcccaacggaccaaccccac

SEQ ID NO: 602497 - DNA, 444 bp, Homo sapiens; identical to SEQ ID NO: 534993
  misc_feature: HIJSMM301D15UN.5.9.A09.1.454.light.4.raw

SEQ ID NO: 602498 - DNA, 447 bp, Homo sapiens; identical to SEQ ID NO: 535201
  misc_feature: HIJSMM301EIMXG.18.9.A09.1.454.light.4.raw

SEQ ID NO: 602499 - DNA, 486 bp, Homo sapiens; identical to SEQ ID NO: 537310
  misc_feature: HIJSMM301DYLFE.15.28.C06.1.454.light.4.raw

SEQ ID NO: 602500 - DNA, 480 bp, Homo sapiens
  misc_feature: HIJSMM301A7LNO.48.19.B08.1.454.light.4.raw
  modified_base (357)..(357): a, c, t, g, unknown or other
  modified_base (442)..(442): a, c, t, g, unknown or other
agtatacatacacgaccggtgctcgatttagtgagtcagtaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaatcatgatttatgatgtcagtaagcggccctcaggggtccctgatcgcttctctggctccaagtctggcaacncggcctccctgaccatctctgggctccaggctgaggatgaggctgattatactgctgctcatatgcaggcagctacacttgggtnttcgggcggagggaccaagctgaccgttcaggtcaacg

SEQ ID NO: 602501 - DNA, 503 bp, Homo sapiens
  misc_feature: HIJSMM301AN6RO.40.80.H03.1.454.light.4.raw
tctagcgactcacgaccggtgctcgatttagctgtgcgtcgaagggaaagggggaggaactgctcagttaggacccagagggaaccatggaagccccagctcagcttctcttcctcctgctactctggctcccagataccgccggagaaattgtgttgacacagtctccagccaccctgtctttatctccaggggaaagagccatcctctcctgcagggccagtcagaatattgatacatacttagcctggtaccagcagaaacctggcctggctcccagggtcctcatccatgatgcctcccacagggccactggcatcccacacaggttcagtggcagtgggtctggggacagacttcagtctcaccatcagcagcctagagcctgaggattttgctaatttatttcttgtcaacagcgtagcaccgtggccccgggtcaccttcggccaagggacacgactggacatgaaacgaactgtggctgccacatctgtcttcta

SEQ ID NO: 602502 - DNA, 505 bp, Homo sapiens; identical to SEQ ID NO: 535503
  misc_feature: HIJSMM301DIQGQ.8.28.C06.1.454.light.4.raw

SEQ ID NO: 602503 - DNA, 505 bp, Homo sapiens
  misc_feature: HIJSMM301B7SYO.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatagcttattggtaccagcagaagtcaggccaggccccaaaattggtcatctatgaagacgacaaacgaccctccgggatccctgagagattctctggctccagctcagggactatggccaccttgactatcagtgggcccgaagtggaggatgaagctgactactactgttactcaatagagaacagtgataatttctgggtgttcggcggagggaccaaactgaccgtcctaggtcagcccaaggctgccccctcggtcactctgtt

SEQ ID NO: 602504 - DNA, 522 bp, Homo sapiens
  misc_feature: HIJSMM301DSB8F.12.71.G05.1.454.light.4.raw
atacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagcccaaggctgccccctcggtcactctcgttcccaccct

SEQ ID NO: 602505 - DNA, 444 bp, Homo sapiens; identical to SEQ ID NO: 537637
  misc_feature: HIJSMM301B7JEL.8.11.A11.1.454.light.4.raw

SEQ ID NO: 602506 - DNA, 503 bp, Homo sapiens; identical to SEQ ID NO: 584187
  misc_feature: HIJSMM301EMUYN.21.81.H04.1.454.light.4.raw

SEQ ID NO: 602507 - DNA, 441 bp, Homo sapiens; identical to SEQ ID NO: 534971
  misc_feature: HIJSMM301BO6AE.11.3.A03.1.454.light.4.raw

SEQ ID NO: 602508 - DNA, 499 bp, Homo sapiens
  misc_feature: HIJSMM301C98CD.49.39.D06.1.454.light.4.raw
agtcgagagacacgaccggtgctcgatttagtgacatctcgcagttctttgggggctctggggagtctgcaccatggcttggaccccactcctcttcctcaccctcctcctccactgcacagggtctctctcccagcttgtagggactctatcgccctctgcctctgccccccgggagcctcggtcaggctcacctgcactctgaaaggtggccacagcagatgcgccatcgcatggcatcacctgcagccagaaaagggccctggtagttgatgaggcttaacactgatggcagccacaacaagggggacgggatccctgatcgcttctaaggctccagttctggggctgagcgctacctcaccatctccagcctccagtctgtggatgaggctgactattcctgtcagacctggggcaggtgggtgttcggcggagggaccaaggtgaccgtcctaggtcagcccaaggctgccccctggtcactctgttcccacct

SEQ ID NO: 602509 - DNA, 504 bp, Homo sapiens
  misc_feature: HIJSMM301DZB06.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaattgagatcaaacgaactgtggctgcaccatctgtcttcatccttcccgcc

SEQ ID NO: 602510 - DNA, 479 bp, Homo sapiens
  misc_feature: HIJSMM301E28W5.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggcttgttcggcggcggg

SEQ ID NO: 602511 - DNA, 487 bp, Homo sapiens
  misc_feature: HIJSMM301BPR3V.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagtagtatggtcacgtcccaagaacttttggccaggggaccaagctggagatcaaacaactgtggctgcaccatct

SEQ ID NO: 602512 - DNA, 505 bp, Homo sapiens; identical to SEQ ID NO: 535503
  misc_feature: HIJSMM301A6GTF.8.28.C06.1.454.light.4.raw

SEQ ID NO: 602513 - DNA, 497 bp, Homo sapiens
  misc_feature: HIJSMM301EPY9H.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaaggaccgagggtggaaatacaaacgaactagtggctgcaccatctgtcttcatt

SEQ ID NO: 602514 - DNA, 503 bp, Homo sapiens
  misc_feature: HIJSMM301C5M3T.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcggactgggaccaagatcaccgtcctaggtcagcccaaggcccaaccccactgtcta

SEQ ID NO: 602515 - DNA, 501 bp, Homo sapiens; identical to SEQ ID NO: 555551
  misc_feature: HIJSMM301DI8YT.21.81.H04.1.454.light.4.raw

SEQ ID NO: 602516 - DNA, 482 bp, Homo sapiens
  misc_feature: HIJSMM301AMMAR.4.39.D06.1.454.light.4.raw
agcactgtagcacgaccggtgctcgatttagtgacatctcgcagttctttgggggagtcagactcagtcaggacacagcatggacatgagggtccccgctcagctcctggggctcctgctgctctggctcccaggtgccgagggtgacatccagctgacccagtcgccctccaccgtgtctgcatccgtaggagacagagtcaccatcacctgtcgggccagtcagaatatttacagttggttggcctggtatcaccagagaccaggagaagcccccaaaacctcctcatttatgatgcctccactttgaatggaggggtcccaccaacattcagcggcagtggatctgggacagagttcactctaaccatcagcagcctgcagcctgatgatcttggaacttatttctgccagcaatataatagttattggacgttcggccagggaccaaggtacgaaatgagacgaactgtggctgcacc

SEQ ID NO: 602517 - DNA, 495 bp, Homo sapiens; identical to SEQ ID NO: 588904
  misc_feature: HIJSMM301AXSF0.11.81.H04.1.454.light.4.raw

SEQ ID NO: 602518 - DNA, 510 bp, Homo sapiens
  misc_feature: HIJSMM301C7Z0K.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttggtccaacgggaccgaaggtaggaaagtacaaacgaactagttggctgcaccatctgtcttctatcttccccg

SEQ ID NO: 602519 - DNA, 486 bp, Homo sapiens; identical to SEQ ID NO: 535043
  misc_feature: HIJSMM301CPTZU.46.35.D02.1.454.light.4.raw

SEQ ID NO: 602520 - DNA, 504 bp, Homo sapiens
  misc_feature: HIJSMM301DZH5X.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactggggctcaggcggaagatgaggctgactattactgtaactcccgggacagcagtgctgaccaggtggtattcggcggagggacccacctgaccgtcttaggtcagcccaaggcctgccccctcggtccta

SEQ ID NO: 602521 - DNA, 454 bp, Homo sapiens; identical to SEQ ID NO: 534964
  misc_feature: HIJSMM301A39HJ.19.86.H09.1.454.light.4.raw

SEQ ID NO: 602522 - DNA, 522 bp, Homo sapiens
  misc_feature: HIJSMM301BA03N.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcgggcggagggaccaggctgaccgtcctaggtcagcccaaggctgccccctgtccactctcgttcccaccct

SEQ ID NO: 602523 - DNA, 492 bp, Homo sapiens; identical to SEQ ID NO: 595623
  misc_feature: HIJSMM301C39YB.41.72.G06.1.454.light.4.raw

SEQ ID NO: 602524 - DNA, 489 bp, Homo sapiens; identical to SEQ ID NO: 549568
  misc_feature: HIJSMM301AO1BJ.43.33.C11.1.454.light.4.raw

SEQ ID NO: 602525 - DNA, 489 bp, Homo sapiens; identical to SEQ ID NO: 542780
  misc_feature: HIJSMM301BLTDY.16.53.E09.1.454.light.4.raw

SEQ ID NO: 602526 - DNA, 506 bp, Homo sapiens; identical to SEQ ID NO: 600353
  misc_feature: HIJSMM301B1YE4.9.71.G05.1.454.light.4.raw

SEQ ID NO: 602527 - DNA, 507 bp, Homo sapiens
  misc_feature: HIJSMM301C3TXQ.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataactactatactattcggcggagggaccaagctgaccgtcctgcgtcagcccaaggctcgccccctcggtccactccg

SEQ ID NO: 602528 - DNA, 507 bp, Homo sapiens; identical to SEQ ID NO: 538063
  misc_feature: HIJSMM301AYSPA.47.85.H08.1.454.light.4.raw

SEQ ID NO: 602529 - DNA, 488 bp, Homo sapiens; identical to SEQ ID NO: 551150
  misc_feature: HIJSMM301DRA6H.13.87.H10.1.454.light.4.raw

SEQ ID NO: 602530 - DNA, 501 bp, Homo sapiens; identical to SEQ ID NO: 569143
  misc_feature: HIJSMM301A6AJ7.18.59.F04.1.454.light.4.raw

SEQ ID NO: 602531 - DNA, 491 bp, Homo sapiens; identical to SEQ ID NO: 555328
  misc_feature: HIJSMM301A9PXJ.14.55.E11.1.454.light.4.raw

SEQ ID NO: 602532 - DNA, 496 bp, Homo sapiens; identical to SEQ ID NO: 566097
  misc_feature: HIJSMM301D7ONL.5.12.B01.1.454.light.4.raw

SEQ ID NO: 602533 - DNA, 469 bp, Homo sapiens
  misc_feature: HIJSMM301BUDJJ.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtctaagtcag

SEQ ID NO: 602534 - DNA, 507 bp, Homo sapiens; identical to SEQ ID NO: 588234
  misc_feature: HIJSMM301AYDHF.19.78.H01.1.454.light.4.raw

SEQ ID NO: 602535 - DNA, 481 bp, Homo sapiens
  misc_feature: HIJSMM301DUGZQ.13.8.A08.1.454.light.4.raw
tcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgacaaatatgtaaattggtatcaacagaagccaggtgaagcccctaagctcctgatctatactgcatccactttgtcaggcggggtcccatcaaggttccgtggcagtggatctgggacagatttcactctcaccatcaccagtctgcaacctgaagactgtgcaacttactactgccaacagtcttacggaacctcgtacacttttggccagggaccaggctggagatcaaacgaactgtggctgcaccatctgtt

SEQ ID NO: 602536 - DNA, 487 bp, Homo sapiens; identical to SEQ ID NO: 554782
  misc_feature: HIJSMM301CQTP3.46.35.D02.1.454.light.4.raw

SEQ ID NO: 602537 - DNA, 510 bp, Homo sapiens; identical to SEQ ID NO: 556890
  misc_feature: HIJSMM301DXPS3.40.47.E03.1.454.light.4.raw

SEQ ID NO: 602538 - DNA, 499 bp, Homo sapiens
  misc_feature: HIJSMM301CYBJ8.48.58.F03.1.454.light.4.raw
agtatacatacacgaccggtgctcgatttagtctgatcgagaagggaaagggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacaatattattatactccgccgacgttcggccggggaccgaacgtggaaatcaaacgaactgtgctgcacat

SEQ ID NO: 602539 - DNA, 505 bp, Homo sapiens
  misc_feature: HIJSMM301BV2V6.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctcctgaccatcagtgggctccggtccgaggatgaggctgactattactgtgcatcacgggacgcaacatgggatgacaatctgagcggttgggtgttcgggcggagggaccaaacgtgaccggtcctagggtcagcccaa

SEQ ID NO: 602540 - DNA, 513 bp, Homo sapiens; identical to SEQ ID NO: 541387
  misc_feature: HIJSMM301EFLJ1.17.33.C11.1.454.light.4.raw

SEQ ID NO: 602541 - DNA, 482 bp, Homo sapiens
  misc_feature: HIJSMM301DYXHY.41.35.D02.1.454.light.4.raw
tctatactatcacgaccggtgctcgatttagcacacgatagttgggtttgggggagtcagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtcccatcaaggtttagcggcagtggatctgggacagaattcactctcacgatcagcggcctgcagcctgatgatgtcgcaacttattactgccaacactatgatagttacccgctcactttcggcgagggaccaaggtggaggtcaagcgaactgtggctgcacca

SEQ ID NO: 602542 - DNA, 489 bp, Homo sapiens
  misc_feature: HIJSMM301B6MJ1.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagattacaattaccctcggacgttcggccagggaccgaaggtggaaatcaaacgaactagtggctgcaccta

SEQ ID NO: 602543 - DNA, 486 bp, Homo sapiens
  misc_feature: HIJSMM301AF1DJ.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatctggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 602544 - DNA, 418 bp, Homo sapiens
  misc_feature: HIJSMM301D7GF0.18.78.H01.1.454.light.4.raw
  modified_base (382)..(382): a, c, t, g, unknown or other
tacgagtatgcacgaccggtgctcgatttagtgtgagtagtttgggtttgggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggcccaaccccnctgtcactctcgttcccgccctcctccatactcgta

SEQ ID NO: 602545 - DNA, 506 bp, Homo sapiens
  misc_feature: HIJSMM301BC7G8.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgggtcagcccaaggctgccccctcggtcactcctgttcccaccctcctctacgtcgtat

SEQ ID NO: 602546 - DNA, 493 bp, Homo sapiens
  misc_feature: HIJSMM301CSY8I.41.24.C02.1.454.light.4.raw
tctatactatcacgaccggtgctcgatttagtacagatcgttagggaaaggggctgggcctcaggaagcagcatcggaggtgcctcagccatggcatggatccctctcttcctcggcgtccttgcttactgcacaggatctgtggcctcctttgagctgactcagccaccctcagtgtccgtgtccccaggacagacagccagcatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtggttcggcggggggaccgaagcgtgaccgtcctaggtcagcccaacggctccg

SEQ ID NO: 602547 - DNA, 504 bp, Homo sapiens; identical to SEQ ID NO: 540538
  misc_feature: HIJSMM301CRP7U.7.71.G05.1.454.light.4.raw

SEQ ID NO: 602548 - DNA, 522 bp, Homo sapiens; identical to SEQ ID NO: 541090
  misc_feature: HIJSMM301DPPHE.27.23.C01.1.454.light.4.raw

SEQ ID NO: 602549 - DNA, 484 bp, Homo sapiens
  misc_feature: HIJSMM301C8K6N.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctagtcagccaaggccaaccca

SEQ ID NO: 602550 - DNA, 521 bp, Homo sapiens
  misc_feature: HIJSMM301A0K79.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattatttgtagttcatatacaaccagtgacacttgggtgttcggcggagggaccaggctgaccgtcctaggtcagcccaaggctgccccctcggtcactctgttcccgcct

SEQ ID NO: 602551 - DNA, 466 bp, Homo sapiens
  misc_feature: HIJSMM301CTVLQ.5.15.B04.1.454.light.4.raw
atcagacacgcacgaccggtgctcgatttagacagtatatatccgcgggggcaggagtcagactcagtcaggacacagcatggacatgagggtccccgctcagctcctggggctcctgctgctctggctcccaggtgccaaatgtgacatccagatgacccagtctccttccaccctgtctgcatctataggagacagagtcaccatcacttgccgggccagtcagagtattagtaactggttggcctggtatcagcagaaaccaggcaaagccccaaagctccttatctctgatgcctccactttgcacggtggggtcccaccaacgttcagcggcagtggatctgggacagaattcactctcaccatcagcagcctgcagcctgatgatgctgcaacttattactgtcaacaatataacagttattggacgttcggccaagggccaaggtggaaatcaaacgaa

SEQ ID NO: 602552 - DNA, 499 bp, Homo sapiens; identical to SEQ ID NO: 557137
  misc_feature: HIJSMM301DNRBO.22.38.D05.1.454.light.4.raw

SEQ ID NO: 602553 - DNA, 496 bp, Homo sapiens; identical to SEQ ID NO: 559406
  misc_feature: HIJSMM301EAJ4L.51.39.D06.1.454.light.4.raw

SEQ ID NO: 602554 - DNA, 484 bp, Homo sapiens; identical to SEQ ID NO: 537893
  misc_feature: HIJSMM301CUUG1.5.42.D09.1.454.light.4.raw

SEQ ID NO: 602555 - DNA, 495 bp, Homo sapiens; identical to SEQ ID NO: 535596
  misc_feature: HIJSMM301CULIZ.10.79.H02.1.454.light.4.raw

SEQ ID NO: 602556 - DNA, 502 bp, Homo sapiens; identical to SEQ ID NO: 541501
  misc_feature: HIJSMM301AOFSG.17.27.C05.1.454.light.4.raw

SEQ ID NO: 602557 - DNA, 490 bp, Homo sapiens
  misc_feature: HIJSMM301D50EQ.5.23.C01.1.454.light.4.raw
atcagacacgcacgaccggtgctcgatttagtacacgtgattagggattgggcacgaccggtgctcgatttagtacacgtgattagggattgggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagccctaagctcctgatctatgctgcatccagtttacaaagtgggtcccatcaaggttcagtggcagtggatctgggacagatttcactctcaccatcagtagtctacaacctgaagattttgcaacttactactgtcaacagagttacgataccctccgctcactttcggcggagggacc

SEQ ID NO: 602558 - DNA, 475 bp, Homo sapiens
  misc_feature: HIJSMM301BJTX3.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgtcgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggccctggactgaagtgcatatgaagagaactgtggctgca

SEQ ID NO: 602559 - DNA, 505 bp, Homo sapiens
  misc_feature: HIJSMM301A0ZHI.2.21.B10.1.454.light.4.raw
acgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctatggtaaaaacaaccggccctcagggatcccagaccgattctctggctcctactcaggaaacacagcttccttgaccatcactggggctcaggcggaagatgaggctgactattattgtaagtccggggacagaagtggtaattacatggtgttcggcggagggaccaagctgaccgtcctacgtcagcccaaggctgccccctcggtcactt

SEQ ID NO: 602560 - DNA, 504 bp, Homo sapiens
  misc_feature: HIJSMM301E08VI.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaaagacggttgggtgttcggcggagggaccaagctgaccgtcctaggtcagcccaaggctgccccctggtcactctgttcccaccctcctcg

SEQ ID NO: 602561 - DNA, 487 bp, Homo sapiens
  misc_feature: HIJSMM301BPN64.48.34.D01.1.454.light.4.raw
agtatacatacacgaccggtgctcgatttagatcgtctgtgttgggtttgggggctgtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggcc

SEQ ID NO: 602562 - DNA, 514 bp, Homo sapiens
  misc_feature: HIJSMM301A35OI.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagccggtgatgaggctgactatttttgtcaggtgtgggacagcagcatttatgtcttcggacctgggaccaaggtcacgtcctaggtcagcccaaggcccaaccccactgtcactctgttcccgccctcctcga

SEQ ID NO: 602563 - DNA, 507 bp, Homo sapiens; identical to SEQ ID NO: 559588
  misc_feature: HIJSMM301COX7Q.19.78.H01.1.454.light.4.raw

SEQ ID NO: 602564 - DNA, 492 bp, Homo sapiens
  misc_feature: HIJSMM301CUTN6.48.34.D01.1.454.light.4.raw
agtatacatacacgaccggtgctcgatttagatcgtctgtgttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaattttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgcccccg

SEQ ID NO: 602565 - DNA, 489 bp, Homo sapiens; identical to SEQ ID NO: 535139
  misc_feature: HIJSMM301COMNA.14.55.E11.1.454.light.4.raw

SEQ ID NO: 602566 - DNA, 502 bp, Homo sapiens
  misc_feature: HIJSMM301BXUPB.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatttgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggaccgaaggtggagttcaaacgaactgtggctgcaccatctgtcttcatcttccccg

SEQ ID NO: 602567 - DNA, 494 bp, Homo sapiens
  misc_feature: HIJSMM301EKS07.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcacacgtgggacatgggcactgcgatcttcggcggagggaccaagctgaccgtcctggtcagcccaaggctgccccctcggtcactt

SEQ ID NO: 602568 - DNA, 498 bp, Homo sapiens
  misc_feature: HIJSMM301CZIVB.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcagggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggcccaacccc

SEQ ID NO: 602569 - DNA, 445 bp, Homo sapiens; identical to SEQ ID NO: 544276
  misc_feature: HIJSMM301CILYS.5.9.A09.1.454.light.4.raw

SEQ ID NO: 602570 - DNA, 521 bp, Homo sapiens; identical to SEQ ID NO: 538715
  misc_feature: HIJSMM301B1WPN.27.23.C01.1.454.light.4.raw

SEQ ID NO: 602571 - DNA, 502 bp, Homo sapiens; identical to SEQ ID NO: 549249
  misc_feature: HIJSMM301BEP2G.21.22.B11.1.454.light.4.raw
  modified_base (460)..(460): a, c, t, g, unknown or other

SEQ ID NO: 602572 - DNA, 472 bp, Homo sapiens; identical to SEQ ID NO: 545405
  misc_feature: HIJSMM301B2A19.3.38.D05.1.454.light.4.raw

SEQ ID NO: 602573 - DNA, 509 bp, Homo sapiens; identical to SEQ ID NO: 536047
  misc_feature: HIJSMM301C5WOM.17.33.C11.1.454.light.4.raw

SEQ ID NO: 602574 - DNA, 486 bp, Homo sapiens; identical to SEQ ID NO: 535385
  misc_feature: HIJSMM301CP4MB.19.71.G05.1.454.light.4.raw

SEQ ID NO: 602575 - DNA, 512 bp, Homo sapiens
  misc_feature: HIJSMM301DSBVK.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggtcggagggaccaagctgaccgtcctaggtcagcccaaggcctgccccctcggtccactctgtt

SEQ ID NO: 602576 - DNA, 504 bp, Homo sapiens
  misc_feature: HIJSMM301BLYR0.13.55.E11.1.454.light.4.raw
tcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcaccatcacttgccgggcaagtcagagcattaccaactatttgaattggtatcaacaaaaccagggagagcccctcacctccttatctatggtgcatccaccttacaaagtggggtcccatcaaggttcagtggcactggatctgggacagatttcactctcaccatcagcagtctgcaacctgaagattttgcaacttattactgtcaacagagtttcagtacgcggacgttcggtccaagggaccgaaggtaggaaatacaaacgaactagtggctgcaccatctgtcttctatcttccccg

SEQ ID NO: 602577 - DNA, 486 bp, Homo sapiens
  misc_feature: HIJSMM301ADDRI.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtcctgacaggttcagtggcagtggatcaggcacagattttacgctgaaaatcagtagggtggaggctgaggatgttggggtttattactgcatgcaagttctacaaacttcctacacttttggccaggggaccaagctggagatcaaacgaa

SEQ ID NO: 602578 - DNA, 463 bp, Homo sapiens; identical to SEQ ID NO: 535062
  misc_feature: HIJSMM301C5QR5.11.73.G07.1.454.light.4.raw

SEQ ID NO: 602579 - DNA, 500 bp, Homo sapiens; identical to SEQ ID NO: 542271
  misc_feature: HIJSMM301EJK79.19.78.H01.1.454.light.4.raw

SEQ ID NO: 602580 - DNA, 511 bp, Homo sapiens; identical to SEQ ID NO: 549861
  misc_feature: HIJSMM301EYO15.19.59.F04.1.454.light.4.raw

SEQ ID NO: 602581 - DNA, 494 bp, Homo sapiens
  misc_feature: HIJSMM301B0CBY.43.33.C11.1.454.light.4.raw
tgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctacaagtgtgggagacagagtcaccctttttgtccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaatttcggtcaggggaccaagttgaacatcaatcgaactgtggctgcaccatctgtcttca

SEQ ID NO: 602582 - DNA, 496 bp, Homo sapiens; identical to SEQ ID NO: 538149
  misc_feature: HIJSMM301D3X2H.13.67.G01.1.454.light.4.raw

SEQ ID NO: 602583 - DNA, 513 bp, Homo sapiens
  misc_feature: HIJSMM301A4NJ5.40.60.F05.1.454.light.4.raw
tctagcgactcacgaccggtgctcgatttagtacgtcatcagggaaagggggaagagctgctcagttaggacccagagggaaccatggaaaccccagcgcagcttctcttcctcctgctactctggctcccagagacccccggagaaattgtgttgacgcagtctccaggcaccctgtctttgtctccaggggaaagagccaccctctcctgcagggccagtcagagtgtaaccaacaactacttaatgtggtaccagcaaaaacctggccaggcctcccaggctcctcatctatggtgcatccaacagggccagtggcatcccagacaggtttagaggcagtggggccgacacagacttcactctcaccatcagcagactggagcctgaagattttgcactgtattactgtcaccagtctgctcacgtacctctcactttcggcggacgggaccgaaggtggagatacaaacgaactgtggctgcaccatctgtcttcatccttcccgccta

SEQ ID NO: 602584 - DNA, 519 bp, Homo sapiens
  misc_feature: HIJSMM301CVRIJ.40.38.D05.1.454.light.4.raw
  modified_base (507)..(507): a, c, t, g, unknown or other
tctagcgactcacgaccggtgctcgatttagtatctgatagttgggtttgggggcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatttcttgttctggaagcaactccaatatcggaactaattatgtatactggtaccagcagctcccaggaacggcccccaaagtcctcttctataggaataatcaacggccctcaggggtccctgaccgattctctgcctccaagtctggcacctctgtgtccctggccatcagtgggctccggtccgaagatgagggtgactattactgtgcagcttgggatgagagcctgagaggttggctgttcggcggagggaccaagctgaccgtcctaggtcagcccaaggctgcccccncggtcactctcg

SEQ ID NO: 602585 - DNA, 489 bp, Homo sapiens
  misc_feature: HIJSMM301EIAWS.17.39.D06.1.454.light.4.raw
cgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaaacctggccaggctcccaggctcctcatgtatggtgcatctaccagggccactggtgtcccagccaggttcagtggcagtgggtctgggacagagttctctctcatcatcagcagcctgcagtctgaagattttgcggtttattactgtcagcagtataatcagtggcctccgtggacgttcggccaagggaccaaggtggaaatcaaacgaactgtggctgca

SEQ ID NO: 602586 - DNA, 471 bp, Homo sapiens
  misc_feature: HIJSMM301BEZRY.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctctccgagtgccacttttggcgggggtaccaaggtggacatcaaacgaa

SEQ ID NO: 602587 - DNA, 511 bp, Homo sapiens
  misc_feature: HIJSMM301AKF03.5.27.C05.1.454.light.4.raw
atcagacacgcacgaccggtgctcgatttagacgcgatcgaagggtttgggagggtttgggaacctatgaacattctgtaggggccactttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtgaaatggtgattatgattatgtcttcggaactgggaccaaggtcaccgtcctaggtcagcccaaggccaaccccactgtcactctgttcccgccctcctccgtgtctgat

SEQ ID NO: 602588 - DNA, 483 bp, Homo sapiens
  misc_feature: HIJSMM301ATTI3.49.69.G03.1.454.light.4.raw
agtcgagagacacgaccggtgctcgatttagtcgctgcgtaaaggagaaagggggaggaactgctcagttaggacccagagggaaccatggaagccccagctcagcttctcttcctcctgcttctctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataattactggctcgttttggccaggggaccaagctggagatcaagcgaactgtggctgcaccat

SEQ ID NO: 602589 - DNA, 494 bp, Homo sapiens; identical to SEQ ID NO: 598786
  misc_feature: HIJSMM301DQB3T.16.86.H09.1.454.light.4.raw

SEQ ID NO: 602590 - DNA, 486 bp, Homo sapiens
  misc_feature: HIJSMM301ED4AW.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagaatttcactctcaccatcaacagtctgcaacctgaagattttgcaacttactactgtcaacagagtttcactacccctctcactttcggcgggggaccgaaggtggagatcaaacgaaactgtggctgcaccta

SEQ ID NO: 602591 - DNA, 495 bp, Homo sapiens; identical to SEQ ID NO: 593302
  misc_feature: HIJSMM301EYUIF.9.1.A01.1.454.light.4.raw

SEQ ID NO: 602592 - DNA, 500 bp, Homo sapiens
  misc_feature: HIJSMM301CWL2P.14.36.D03.1.454.light.4.raw
cgtctagtaccacgaccggtgctcgatttagctgcgtcacgatctctcttggggggggtctcaggaggcagctctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaactcatgatttatgaggtcagtaatcggccctcaggggtttctaatcgcttctctggctccaagtctggcaacacggcctccctgaccatctctgggctccaggctgaggacgagtctgattattattgcagctcatatgcacctggcagcaatcatgtggttttcggcggggggtaccaaggtgaccgtcctaggtcagcccaaggtccg

SEQ ID NO: 602593 - DNA, 509 bp, Homo sapiens; identical to SEQ ID NO: 547302
  misc_feature: HIJSMM301CXE25.4.57.F02.1.454.light.4.raw

SEQ ID NO: 602594 - DNA, 503 bp, Homo sapiens; identical to SEQ ID NO: 572163
  misc_feature: HIJSMM301DJH7B.4.71.G05.1.454.light.4.raw

SEQ ID NO: 602595 - DNA, 499 bp, Homo sapiens; identical to SEQ ID NO: 538774
  misc_feature: HIJSMM301CLQHM.26.26.C04.1.454.light.4.raw

SEQ ID NO: 602596 - DNA, 511 bp, Homo sapiens; identical to SEQ ID NO: 583021
  misc_feature: HIJSMM301CQV23.19.59.F04.1.454.light.4.raw

SEQ ID NO: 602597 - DNA, 505 bp, Homo sapiens
  misc_feature: HIJSMM301AZF4D.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtca

SEQ ID NO: 602598 - DNA, 494 bp, Homo sapiens; identical to SEQ ID NO: 536886
  misc_feature: HIJSMM301AS9TC.10.33.C11.1.454.light.4.raw

SEQ ID NO: 602599 - DNA, 497 bp, Homo sapiens
  misc_feature: HIJSMM301CUU0K.22.57.F02.1.454.light.4.raw
acatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcaatggatctgggacagaattcactctcaccaatcaacagcctgcagcctgatgattttggcaacttactaactgccaaccgtatagtacttattcggtcaccttcgccaagggacacgactggagattaaacgaaactgtggctgcaccatctgtcttcatt

SEQ ID NO: 602600 - DNA, 482 bp, Homo sapiens
  misc_feature: HIJSMM301A08NC.8.14.B03.1.454.light.4.raw
ctcgcgtgtccacgaccggtgctcgatttagtgtgagtagttccgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgcccagtggcatcaatttccatacctttagtgtatattggtatcagcagaagccagggagtcctccccactatctcctgaggtataaaacagactcagataaggagcaggcctctggagtccccagccgcttctctggatccaaagatgctgcggccaatgcagggagtttgctcatctctgggctccagtttgaggatgaggctgactattattgtatgatttggtacaggagcgcttgggtgatcgggcggaggggaccaagctgaccgtcctaggtcagccc

SEQ ID NO: 602601 - DNA, 499 bp, Homo sapiens; identical to SEQ ID NO: 555737
  misc_feature: HIJSMM301BSQC0.11.59.F04.1.454.light.4.raw

SEQ ID NO: 602602 - DNA, 505 bp, Homo sapiens
  misc_feature: HIJSMM301AEF4E.18.26.C04.1.454.light.4.raw
tacgagtatgcacgaccggtgctcgatttagtctagcgactttgggtttgggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccgaaggtagaggatcaaaggaactagtggctgcaccatctgtcttcatcttcccgccta

SEQ ID NO: 602603 - DNA, 483 bp, Homo sapiens; identical to SEQ ID NO: 537608
  misc_feature: HIJSMM301ADJX0.47.46.E02.1.454.light.4.raw

SEQ ID NO: 602604 - DNA, 480 bp, Homo sapiens
  misc_feature: HIJSMM301E2A0X.15.8.A08.1.454.light.4.raw
tctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgcagtctgaagattttgcagtttattactgtcagcaatataacaagtggccattcactttcggcccacgggaccaaagtaggagtatacaaacgaaactagtggctgcaccactctgtcttcatcttccgtccact

SEQ ID NO: 602605 - DNA, 495 bp, Homo sapiens; identical to SEQ ID NO: 535596
  misc_feature: HIJSMM301AFQVX.10.79.H02.1.454.light.4.raw

SEQ ID NO: 602606 - DNA, 495 bp, Homo sapiens; identical to SEQ ID NO: 535486
  misc_feature: HIJSMM301D42UK.26.72.G06.1.454.light.4.raw

SEQ ID NO: 602607 - DNA, 494 bp, Homo sapiens
  misc_feature: HIJSMM301AIVRG.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcggggtctgggacagatttcactctcaccatcagcagcctgcaggctgaagatgtggcagtttattactgtcaacaatattataataatccatttaatttcggtcggagggaccaaggtggaggatcaaacgaactgtggctgcaccatctgtcttcatcttcccgcca

SEQ ID NO: 602608 - DNA, 504 bp, Homo sapiens; identical to SEQ ID NO: 553852
  misc_feature: HIJSMM301BKWU6.4.57.F02.1.454.light.4.raw

SEQ ID NO: 602609 - DNA, 495 bp, Homo sapiens
  misc_feature: HIJSMM301AIEHK.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggtcagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaaacaccttcggccaagggacacgactggagattaaaggaactgtggctgcaccatctgtcttcatcttccccg

SEQ ID NO: 602610 - DNA, 500 bp, Homo sapiens
  misc_feature: HIJSMM301CBCEJ.9.1.A01.1.454.light.4.raw
tgatacgtctcacgaccggtgctcgatttagacgtctcatcagggggagctgctcagttaggacccaggagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggccttggtaccagcagaaatctggccagcctcccaggctcctcatctatggtgaatccaacagggccactggcatcccagaccaggttcaggtggcagtgggtctgggacagacttcactctcaccatcagcagactggagcctgaggattttgcagtgtattactgtcagcagtatcataggtcaaacaccttcggccaagggacacgactggaagagttaaaggaactgtggctgcaccatctgtcttcatcttccccg

SEQ ID NO: 602611 - DNA, 486 bp, Homo sapiens; identical to SEQ ID NO: 535043
  misc_feature: HIJSMM301CGJ2W.46.35.D02.1.454.light.4.raw

SEQ ID NO: 602612 - DNA, 500 bp, Homo sapiens; identical to SEQ ID NO: 581055
  misc_feature: HIJSMM301B8N6A.15.1.A01.1.454.light.4.raw

SEQ ID NO: 602613 - DNA, 500 bp, Homo sapiens
  misc_feature: HIJSMM301BFMAX.52.27.C05.1.454.light.4.raw
cgcagtacgacacgaccggtgctcgatttagacgcgatcgaagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaacaaaaacctgcccaggctcccaggctcctcatctatgatgcatccaatcgggccactggcatcccagccaggttcagtggcagtgggtctgggacagacttcactctcaccatcagcaacctagagcctgaagactttgcagtttattactgtcagcagcgtagtaagtggcgcttcggccaagggacacgactggaggttaaacgaactgtggctgcaccatctgtcttcatcttcccgccatctgata

SEQ ID NO: 602614 - DNA, 501 bp, Homo sapiens; identical to SEQ ID NO: 536142
  misc_feature: HIJSMM301ECUL6.15.1.A01.1.454.light.4.raw

SEQ ID NO: 602615 - DNA, 482 bp, Homo sapiens
  misc_feature: HIJSMM301EEUKO.49.81.H04.1.454.light.4.raw
agtcgagagacacgaccggtgctcgatttagtagtgtagattcgcgggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggcggagggaccacggtggagatcaaacgaactgtggctgcaccatctgtcttc

SEQ ID NO: 602616 - DNA, 501 bp, Homo sapiens; identical to SEQ ID NO: 584481
  misc_feature: HIJSMM301DWBY1.4.39.D06.1.454.light.4.raw

SEQ ID NO: 602617 - DNA, 498 bp, Homo sapiens
  misc_feature: HIJSMM301EK1QS.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccgaggggaccaagctggagatcaaacgaactgtggctgcaccatctgtt

SEQ ID NO: 602618 - DNA, 495 bp, Homo sapiens; identical to SEQ ID NO: 538434
  misc_feature: HIJSMM301BUQLE.51.81.H04.1.454.light.4.raw

SEQ ID NO: 602619 - DNA, 494 bp, Homo sapiens; identical to SEQ ID NO: 534994
  misc_feature: HIJSMM301BQNYN.27.78.H01.1.454.light.4.raw

SEQ ID NO: 602620 - DNA, 478 bp, Homo sapiens
  misc_feature: HIJSMM301BMBTO.7.67.G01.1.454.light.4.raw
cgtgtctctacacgaccggtgctcgatttagagtatacatattgggtttgggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctcccacagcggggcaggttctgatgttcactggtaccagcagcttccagggacagcccccaaactcctcatatacgagaacaccaatcggccctcaggagtcccctgaccgattctctggctccaagtctggcacctcagcctccctggccatcactgggctccaggctgaggatgagctgattattactgccagtcgtatgacagcagcctgagtgtttgggtgttcgggcggaggga

SEQ ID NO: 602621 - DNA, 516 bp, Homo sapiens
  misc_feature: HIJSMM301BQTZW.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtccactctcgttcccaccctcct

SEQ ID NO: 602622 - DNA, 505 bp, Homo sapiens; identical to SEQ ID NO: 554737
  misc_feature: HIJSMM301AU0YJ.40.67.G01.1.454.light.4.raw

SEQ ID NO: 602623 - DNA, 500 bp, Homo sapiens; identical to SEQ ID NO: 543863
  misc_feature: HIJSMM301BPJ1B.12.26.C04.1.454.light.4.raw

SEQ ID NO: 602624 - DNA, 489 bp, Homo sapiens; identical to SEQ ID NO: 539602
  misc_feature: HIJSMM301COMSA.16.68.G02.1.454.light.4.raw

SEQ ID NO: 602625 - DNA, 471 bp, Homo sapiens; identical to SEQ ID NO: 539388
  misc_feature: HIJSMM301CR9ZK.13.39.D06.1.454.light.4.raw

SEQ ID NO: 602626 - DNA, 486 bp, Homo sapiens; identical to SEQ ID NO: 536553
  misc_feature: HIJSMM301C4OU7.17.34.D01.1.454.light.4.raw

SEQ ID NO: 602627 - DNA, 497 bp, Homo sapiens; identical to SEQ ID NO: 545672
  misc_feature: HIJSMM301CKMJ2.2.49.E05.1.454.light.4.raw

SEQ ID NO: 602628 - DNA, 507 bp, Homo sapiens; identical to SEQ ID NO: 590944
  misc_feature: HIJSMM301B5LTL.9.55.E11.1.454.light.4.raw

SEQ ID NO: 602629 - DNA, 498 bp, Homo sapiens
  misc_feature: HIJSMM301CZ2BB.52.65.F10.1.454.light.4.raw
cgcagtacgacacgaccggtgctcgatttagctacgctctaagggggcaggagtcagacccagtcaggacacagcatggacatgagggtccccgctcagctcctggggctcctgctgctctggttcccaggtgccaggtgcgacatccagatgacccagtctccatcttccgtgtctgcatctgtaggagacagagtcaccatcacttgtcgggcgagtcaggttgttagcgcctggttagcctggtatcagcagaaaccagggaaagcccctaaagtcctggtctatgctacatccaatttgcaaagtggcgtccctcaaggttccgcggcagtggatctgggacaaatttcactctcaccatcagcagcctgcagcctgaagattttgcgacttactattgtcaacaggggtacagttttccgtacacctttggccaggggactaagctggacatcaaacgaactgtggctgcaccatctgtcttcatcttccccg

SEQ ID NO: 602630 - DNA, 502 bp, Homo sapiens; identical to SEQ ID NO: 560287
  misc_feature: HIJSMM301A98YK.10.71.G05.1.454.light.4.raw

SEQ ID NO: 602631 - DNA, 482 bp, Homo sapiens; identical to SEQ ID NO: 560945
  misc_feature: HIJSMM301ARLYX.13.8.A08.1.454.light.4.raw

SEQ ID NO: 602632 - DNA, 505 bp, Homo sapiens; identical to SEQ ID NO: 535503
  misc_feature: HIJSMM301A6R3N.8.28.C06.1.454.light.4.raw

SEQ ID NO: 602633 - DNA, 494 bp, Homo sapiens; identical to SEQ ID NO: 541035
  misc_feature: HIJSMM301BHRKT.26.12.B01.1.454.light.4.raw

SEQ ID NO: 602634 - DNA, 500 bp, Homo sapiens
  misc_feature: HIJSMM301A965C.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtggaaagtacaaacgaactagtggctgcacca

SEQ ID NO: 602635 - DNA, 484 bp, Homo sapiens; identical to SEQ ID NO: 537878
  misc_feature: HIJSMM301ASONB.17.34.D01.1.454.light.4.raw

SEQ ID NO: 602636 - DNA, 505 bp, Homo sapiens
  misc_feature: HIJSMM301E1HJN.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcgggagggaccaaaactgaccgtcctagggtcagcccaa

SEQ ID NO: 602637 - DNA, 486 bp, Homo sapiens; identical to SEQ ID NO: 535043
  misc_feature: HIJSMM301CUIJY.46.35.D02.1.454.light.4.raw

SEQ ID NO: 602638 - DNA, 493 bp, Homo sapiens; identical to SEQ ID NO: 571811
  misc_feature: HIJSMM301C9L5G.18.11.A11.1.454.light.4.raw

SEQ ID NO: 602639 - DNA, 484 bp, Homo sapiens; identical to SEQ ID NO: 535400
  misc_feature: HIJSMM301DR6CH.46.26.C04.1.454.light.4.raw

SEQ ID NO: 602640 - DNA, 494 bp, Homo sapiens; identical to SEQ ID NO: 534994
  misc_feature: HIJSMM301EQRVD.27.78.H01.1.454.light.4.raw

SEQ ID NO: 602641 - DNA, 511 bp, Homo sapiens
  misc_feature: HIJSMM301C5NVF.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtgtgttcggcggagggaccaagctggccgtcctaggtcagcccaaggctgccccctggtcactctgttcccacctcctcgagtagtaca

SEQ ID NO: 602642 - DNA, 520 bp, Homo sapiens; identical to SEQ ID NO: 537173
  misc_feature: HIJSMM301CBMGG.27.23.C01.1.454.light.4.raw

SEQ ID NO: 602643 - DNA, 486 bp, Homo sapiens; identical to SEQ ID NO: 536323
  misc_feature: HIJSMM301DHOZ1.10.2.A02.1.454.light.4.raw

SEQ ID NO: 602644 - DNA, 511 bp, Homo sapiens
  misc_feature: HIJSMM301A4HB3.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggaggggaccgaaggtaggagaatcaaacgaactagtggctgcaccatctgtt

SEQ ID NO: 602645 - DNA, 494 bp, Homo sapiens; identical to SEQ ID NO: 534992
  misc_feature: HIJSMM301BB62V.9.1.A01.1.454.light.4.raw

SEQ ID NO: 602646 - DNA, 486 bp, Homo sapiens; identical to SEQ ID NO: 536261
  misc_feature: HIJSMM301BW6UK.26.55.E11.1.454.light.4.raw

SEQ ID NO: 602647 - DNA, 507 bp, Homo sapiens
  misc_feature: HIJSMM301CQQH0.8.2.A02.1.454.light.4.raw
ctcgcgtgtccacgaccggtgctcgatttagactcatctacagggggaggaactgctcagttaggacccagagggaaccatggaagccccagctcagcttctcttcctcctgctactctggctcccaggtaccaccggagagattgtgttgacgcagtcgccagccaccctgtctttgtctccaggggacagagtcaccctctcctgtagggccagttatggtgttggcggctacttagcctggtaccaacaaaaacgtggccaggctcccaggctcctcatctatgaagcatccaccagggccactggcatcccagccaggttcaatggcagtgggtctgggacagacttcactctcaccatcagcagcctggagcctgaagatattgcagtttattactgtcaacatcgtaccgagtggcctccggggccactttcggccctgggaccaaggtggagatacaaacgaactgtggctgcaccatctgtcttcatcttcccgccact

SEQ ID NO: 602648 - DNA, 502 bp, Homo sapiens
  misc_feature: HIJSMM301DA6JM.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaaccgtctaggtcagcccaaggctgccccctc

SEQ ID NO: 602649 - DNA, 508 bp, Homo sapiens
  misc_feature: HIJSMM301CDCQP.47.85.H08.1.454.light.4.raw
agctcacgtacacgaccggtgctcgatttagtatcactcagtcgcgggggctggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgccctcaggggtttctcatcgcttctctggctccaaatctggcaacacggcctccctgaccatctctgggctcgagtctgaggacgaggctgatttacttctgttgctcttgggcaactactgtcgttttgggtgttcggcggagggaccaagttgaccgtcctaggtcagcccaaggctgccccctcggtcact

SEQ ID NO: 602650 - DNA, 465 bp, Homo sapiens; identical to SEQ ID NO: 538589
  misc_feature: HIJSMM301C8G1Q.12.39.D06.1.454.light.4.raw

SEQ ID NO: 602651 - DNA, 480 bp, Homo sapiens; identical to SEQ ID NO: 535975
  misc_feature: HIJSMM301BSLMX.51.60.F05.1.454.light.4.raw

SEQ ID NO: 602652 - DNA, 497 bp, Homo sapiens
  misc_feature: HIJSMM301AXTS3.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaacgcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttcccgccctcctcgagtgcgtct

SEQ ID NO: 602653 - DNA, 481 bp, Homo sapiens; identical to SEQ ID NO: 556773
  misc_feature: HIJSMM301AW6ED.40.59.F04.1.454.light.4.raw

SEQ ID NO: 602654 - DNA, 489 bp, Homo sapiens; identical to SEQ ID NO: 543840
  misc_feature: HIJSMM301ANE2J.12.88.H11.1.454.light.4.raw

SEQ ID NO: 602655 - DNA, 507 bp, Homo sapiens; identical to SEQ ID NO: 592523
  misc_feature: HIJSMM301CTKNX.8.19.B08.1.454.light.4.raw

SEQ ID NO: 602656 - DNA, 510 bp, Homo sapiens
  misc_feature: HIJSMM301CXVK3.52.76.G10.1.454.light.4.raw
cgcagtacgacacgaccggtgctcgatttagtcactcatacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataactctgtctcctggtaccaacaatacccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatacacaaacagaaacacttgggtgttcggcggcggggaccaaactgaccgtcctacgtcagcccaaggctgccccctcggtcactctgttccca

SEQ ID NO: 602657 - DNA, 479 bp, Homo sapiens
  misc_feature: HIJSMM301EGCGL.26.72.G06.1.454.light.4.raw
agactatactcacgaccggtgctcgatttagctacgactgcaagggaaagggtgagatccctcactgtggctcactttcagcggagggaccacggtggagatcacacgtaagtgcactttcctaatgctttttcttataaggttttaagtttggagcgtttttgtgtttgagatgttagctcaggtcaattccaaagagtaccagattctttcaaaaagtcagatgagtaagggatagaaaattagttcaccttaaggaacagccaagcgctagccagttaagtgaggcatctcaattgcaaggttttctctgcatcggtcaggttagtgatattaacagcgaaaagagatttttgttaaggggaaagtaatgaagttaacactgtggatcaccttcggccaagggacacgactggagattaaacgaaactgtggctgcaccatctgtcttcatcttcccgccatctgaagtatagtct

SEQ ID NO: 602658 - DNA, 482 bp, Homo sapiens
  misc_feature: HIJSMM301EE7SU.17.67.G01.1.454.light.4.raw
cgtagactagcacgaccggtgctcgatttagagtatacatattgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagggtcaccatcacttgccgggcaagtcacagcattagcagctatttaaattggtatcagcagaaaccagggagagcccctaacctcctgatctatgctgcatccagtttgcagagtggggtcccatcaaggttcagtggcagtggatctgggacagatttcactctcaccatcagcagtctgcaacctgaagatttgcaacttactactgtcaacagagtctcagtacccccggagttcggccgaggaccagggtggaagtcaaacgaactgtaggctgcacctac

SEQ ID NO: 602659 - DNA, 487 bp, Homo sapiens
  misc_feature: HIJSMM301D920F.52.25.C03.1.454.light.4.raw
cgcagtacgacacgaccggtgctcgatttagtagtgtagatttgggtttggggcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatggtgcatcaactttgcaaggtggggtcccatcaaggttcagcggcagtggatctgggacagaattcactctcacaatcagcagcctgcagcctgaagattttgcaacttattactgtcaacaccttaatagttactccttcactttcggccctgggaccaagtggacatacaaacgaactgtggctgcaccatctgtctt

SEQ ID NO: 602660 - DNA, 493 bp, Homo sapiens; identical to SEQ ID NO: 571339
  misc_feature: HIJSMM301COR4U.10.72.G06.1.454.light.4.raw

SEQ ID NO: 602661 - DNA, 489 bp, Homo sapiens; identical to SEQ ID NO: 535139
  misc_feature: HIJSMM301D4EC8.14.55.E11.1.454.light.4.raw

SEQ ID NO: 602662 - DNA, 479 bp, Homo sapiens; identical to SEQ ID NO: 538892
  misc_feature: HIJSMM301BGGUJ.22.59.F04.1.454.light.4.raw

SEQ ID NO: 602663 - DNA, 485 bp, Homo sapiens; identical to SEQ ID NO: 544254
  misc_feature: HIJSMM301AT9LG.52.33.C11.1.454.light.4.raw

SEQ ID NO: 602664 - DNA, 519 bp, Homo sapiens
  misc_feature: HIJSMM301CC9EJ.27.23.C01.1.454.light.4.raw
  modified_base (509)..(509): a, c, t, g, unknown or other
agcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactcngttccaccct

SEQ ID NO: 602665 - DNA, 480 bp, Homo sapiens
  misc_feature: HIJSMM301CMPGI.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacggatttcactctcaccatcaacagtctgcaacctgaagattttgcaacttactactgtcaacagagtttcactacccctctcactttcggcgggggaccaaggtggagatcaaacgaactgtggctgcac

SEQ ID NO: 602666 - DNA, 484 bp, Homo sapiens; identical to SEQ ID NO: 535400
  misc_feature: HIJSMM301EC82S.46.26.C04.1.454.light.4.raw

SEQ ID NO: 602667 - DNA, 502 bp, Homo sapiens
  misc_feature: HIJSMM301DTZ42.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtctaggtcagcccaaggctgccccctac

SEQ ID NO: 602668 - DNA, 485 bp, Homo sapiens; identical to SEQ ID NO: 535880
  misc_feature: HIJSMM301CG9P0.7.75.G09.1.454.light.4.raw

SEQ ID NO: 602669 - DNA, 501 bp, Homo sapiens
  misc_feature: HIJSMM301ARBM1.19.78.H01.1.454.light.4.raw
  modified_base (438)..(438): a, c, t, g, unknown or other
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctnttatgtcttcggaactgggaccaaggtcacgtcctaggtcagcccaaggccaacccactgtca

SEQ ID NO: 602670 - DNA, 490 bp, Homo sapiens
  misc_feature: HIJSMM301A65DB.49.82.H05.1.454.light.4.raw
agtcgagagacacgaccggtgctcgatttagtcgagctctctcgcgggcacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggtcggagggaccgacggtggag

SEQ ID NO: 602671 - DNA, 521 bp, Homo sapiens; identical to SEQ ID NO: 538715
  misc_feature: HIJSMM301CYTMS.27.23.C01.1.454.light.4.raw

SEQ ID NO: 602672 - DNA, 499 bp, Homo sapiens
  misc_feature: HIJSMM301DN8E7.14.59.F04.1.454.light.4.raw
cgtctagtaccacgaccggtgctcgatttagtacacacacttagggattgggggatcaggactcctcagttcaccttctcacaatgaggctccctgctcagctcctggggctgctaatgctctgggtctctggatccagtggggatattgtgatgactcagtctccactttccctgaccgtcaccctggagagccggcctccatctcctgcaggtctagtcagagcctcctgcatactaatggaaacaacttttttggattggtacctgcagaagccagggcagtctccacagctcctgatctatttgggttctaatcgggcctccggagtccctgacaggttcagtggcagtggatcaggcacagattttacactgaaaatcagcagagtggaggctgaggatgttggggtttattactgcatgcaagctctacaaactcgaacgttcggccaagggaccaaggtggaaatcaaacgaactgtggctgcaccatctgt

SEQ ID NO: 602673 - DNA, 500 bp, Homo sapiens
  misc_feature: HIJSMM301C2QC1.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggactgggaccaagatcaccgtcctaggtcagcccaaggccaacaccactgt

SEQ ID NO: 602674 - DNA, 485 bp, Homo sapiens
  misc_feature: HIJSMM301CPNNN.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgctactttattactgtcagcagcgtagcaactggcctctcactttcggcggagggaccgagggtggagatcagacgaa

SEQ ID NO: 602675 - DNA, 441 bp, Homo sapiens
  misc_feature: HIJSMM301AYIW8.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccaccaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttcccgccctcctcgtatctctcg

SEQ ID NO: 602676 - DNA, 483 bp, Homo sapiens; identical to SEQ ID NO: 574472
  misc_feature: HIJSMM301BQNXG.26.60.F05.1.454.light.4.raw

SEQ ID NO: 602677 - DNA, 505 bp, Homo sapiens; identical to SEQ ID NO: 580735
  misc_feature: HIJSMM301CGK5Y.4.71.G05.1.454.light.4.raw

SEQ ID NO: 602678 - DNA, 521 bp, Homo sapiens
  misc_feature: HIJSMM301DAMSY.2.21.B10.1.454.light.4.raw
acgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctatggtaaaaacaaccggccctcagggatcccagaccgattctctggctcctactcaggaaacacagcttccttgaccatcactgggcgtcaggcggaagatgaggctgactattattgtaagtccgggacgagaagtggtaattacatggtgttcggcggagggaccgaacgactgaccgtccgtacgtcacgcccaacggctaacgccccctccggtcctactctccg

SEQ ID NO: 602679 - DNA, 441 bp, Homo sapiens; identical to SEQ ID NO: 534971
  misc_feature: HIJSMM301BP8PK.11.3.A03.1.454.light.4.raw

SEQ ID NO: 602680 - DNA, 487 bp, Homo sapiens
  misc_feature: HIJSMM301CGCXK.10.53.E09.1.454.light.4.raw
catagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttattcagctccgacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgcggcagtttattactgtcagcactattatagtaccccattcacattccggccctgggaccaaagtggagatcaaacgaa

SEQ ID NO: 602681 - DNA, 504 bp, Homo sapiens; identical to SEQ ID NO: 542968
  misc_feature: HIJSMM301COC8U.11.57.F02.1.454.light.4.raw

SEQ ID NO: 602682 - DNA, 485 bp, Homo sapiens
  misc_feature: HIJSMM301DBI4V.14.53.E09.1.454.light.4.raw
cgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgcttttttggaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcggtgttcggcggagggaccaagctgaccgtcctaggtcagcccaaggcctgccccctcggtcta

SEQ ID NO: 602683 - DNA, 372 bp, Homo sapiens
  misc_feature: HIJSMM301DCCVO.21.25.C03.1.454.light.4.raw
tcgtcgctcgcacgaccggtgctcgatttagtagtgtagatttgggtttgggagcagctccaacatcgggtcaccttttgatgtgcactggtatcagcaacttccaggaacagcccccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggctgttcggcggcgggaccaagctgaccgtcctaggtcagccccaaggctgcccctcggtcactctgttcccaccctcctccgagcgacga

SEQ ID NO: 602684 - DNA, 497 bp, Homo sapiens
  misc_feature: HIJSMM301AVTOC.16.10.A10.1.454.light.4.raw
tgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagaggccctcagggatccctgggcgattctctggctccagctcagggacgacagtcacgttgaccatcggtggagtccaggcagaagacgagggtgactattactgtcagtctgcaaacaccactgcagcggtgttcgggcggagggaccaagctgaccgtcctgcgtcagcccaaggctgccccctcggtcactctgttcccta

SEQ ID NO: 602685 - DNA, 506 bp, Homo sapiens
  misc_feature: HIJSMM301BYYNC.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggttattactgcatgcaaactacacacggccgctcactttcggcggagggaccaaggtggaggatcaaacgaactgtggctgcaccatctgtt

SEQ ID NO: 602686 - DNA, 496 bp, Homo sapiens
  misc_feature: HIJSMM301EG6QA.40.54.E10.1.454.light.4.raw
tctagcgactcacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccagcatcacctgctctggagattcattgtcaaagcaatatgcttattggtaccagcagaagccaggccaggcccctgtggtggtgctatataaagacactgagaggccctcagggacccctgagcgattctctggctccaggtcagggacaacagtcacgttgaccatcagtggagtccaggcagaagacgaggctgactattactgtcaatcagcagacagcagtggtacttttcgggttttcggtcggagggaccaagctgaccgtcctaggtcagcccaaggctgccccctcc

SEQ ID NO: 602687 - DNA, 509 bp, Homo sapiens; identical to SEQ ID NO: 586865
  misc_feature: HIJSMM301A61TI.9.33.C11.1.454.light.4.raw

SEQ ID NO: 602688 - DNA, 491 bp, Homo sapiens
  misc_feature: HIJSMM301BIIEE.8.53.E09.1.454.light.4.raw
ctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactacacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgtccactcctatgacaacagcctgagtattggctgttcggcggcgggaccaagttgtaccg

SEQ ID NO: 602689 - DNA, 509 bp, Homo sapiens
  misc_feature: HIJSMM301BF0CG.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgctagtttattactgtcaacatcgtaccgagtggccgtccgggggccactttcggccctcgggaccaaagtggagtatacaacgaactgtggctgcaccatctgtctt

SEQ ID NO: 602690 - DNA, 473 bp, Homo sapiens; identical to SEQ ID NO: 535262
  misc_feature: HIJSMM301CCFHK.8.67.G01.1.454.light.4.raw

SEQ ID NO: 602691 - DNA, 488 bp, Homo sapiens
  misc_feature: HIJSMM301C5FB2.51.77.G11.1.454.light.4.raw
  modified_base (409)..(409): a, c, t, g, unknown or other
  modified_base (417)..(417): a, c, t, g, unknown or other
cgatcgtatacacgaccggtgctcgatttagctagtcactcaagggaaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaaaactcctgatctatgctgcatccagtttgcaaagtgaggtcccatccaggttcagtggcagtggatctgggacagatttcactctcaccatcagtaatctgcaacctgaaagattttgcaacttactacngtcaacanagtacgtaaccctgctcacttcgtcggagggaccgaaggaggaggaatacgaaacgaaacctaatggcgtg

SEQ ID NO: 602692 - DNA, 499 bp, Homo sapiens; identical to SEQ ID NO: 550492
  misc_feature: HIJSMM301CEDL3.43.66.F11.1.454.light.4.raw

SEQ ID NO: 602693 - DNA, 478 bp, Homo sapiens
  misc_feature: HIJSMM301CDVP7.12.1.A01.1.454.light.4.raw
atacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgcaacttattactgtcaacagagtaacagttaccctcccactttcggcggagggaccaaggtggagagtcaaacgaactgtggctgca

SEQ ID NO: 602694 - DNA, 507 bp, Homo sapiens; identical to SEQ ID NO: 563344
  misc_feature: HIJSMM301AUVS4.3.79.H02.1.454.light.4.raw

SEQ ID NO: 602695 - DNA, 505 bp, Homo sapiens
  misc_feature: HIJSMM301ALER0.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtggaaatacaaacgaactagtggctgcaccatctgtcttcatcttccccg

SEQ ID NO: 602696 - DNA, 502 bp, Homo sapiens
  misc_feature: HIJSMM301DVBT9.48.53.E09.1.454.light.4.raw
agtatacatacacgaccggtgctcgatttagagagagtgtgttgggtttggggagagccctggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtt

SEQ ID NO: 602697 - DNA, 488 bp, Homo sapiens; identical to SEQ ID NO: 535081
  misc_feature: HIJSMM301ARE6Q.26.23.C01.1.454.light.4.raw

SEQ ID NO: 602698 - DNA, 490 bp, Homo sapiens; identical to SEQ ID NO: 535526
  misc_feature: HIJSMM301CBEJD.26.78.H01.1.454.light.4.raw

SEQ ID NO: 602699 - DNA, 444 bp, Homo sapiens; identical to SEQ ID NO: 537971
  misc_feature: HIJSMM301ANZXI.2.76.G10.1.454.light.4.raw

SEQ ID NO: 602700 - DNA, 501 bp, Homo sapiens
  misc_feature: HIJSMM301AWR1M.48.36.D03.1.454.light.4.raw
  modified_base (412)..(412): a, c, t, g, unknown or other
agtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacatggcctccctgaccatctctgggctccaggctgaagatcaggctgattnttactgctgttcattttcaagttcctttttgtcttcggaactgggaccgaggtcaccgtcctaggtcagcccaaggccaacccactcgt

SEQ ID NO: 602701 - DNA, 501 bp, Homo sapiens; identical to SEQ ID NO: 536867
  misc_feature: HIJSMM301B655O.5.86.H09.1.454.light.4.raw

SEQ ID NO: 602702 - DNA, 490 bp, Homo sapiens
  misc_feature: HIJSMM301AXY7G.41.57.F02.1.454.light.4.raw
tctatactatcacgaccggtgctcgatttagctcgatatagttgggtttggggtccaaacagagcttcagcaagcatagtgggaatctgcaccataccctgggctctgctcctcctgaccctcctcactcactctgcagtgtcagtggtccaggcaggactgactcagccaccctcggtgtccaagggcttgagacagaccgccacactcacctgcactgggaacagctacaatgttggcaacgaaggagcagcttggctgcagcagtaccagggccaccctcccaaattgctatcatacaggaagaacaaccgcccctcggggatctccgagagattctctgcatcaacgtcaggaaacatagcctccctgaccattactggactccagcctgaggacgaggctgactattactgctcagcatgggacagcagcctcaatgtttgggtgttcggcggagggaccaagctgaccgtcctaggtcagcccc

SEQ ID NO: 602703 - DNA, 507 bp, Homo sapiens
  misc_feature: HIJSMM301BTLGE.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtctaacatcgtaccgagtggcctccgggggccactttcggcctcgggaccaagtaggatatacaaacgaactgtggctgcaccatctgtctt

SEQ ID NO: 602704 - DNA, 489 bp, Homo sapiens
  misc_feature: HIJSMM301EORIN.43.33.C11.1.454.light.4.raw
tgtgagtagtcacgaccggtgctcgatttagagtgagctcgttgggtttggggagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaatttcggtcaggggaccaagttgaacatcaatcgaactgtgctgcaccatctgt

SEQ ID NO: 602705 - DNA, 505 bp, Homo sapiens; identical to SEQ ID NO: 586297
  misc_feature: HIJSMM301EHH0L.8.28.C06.1.454.light.4.raw

SEQ ID NO: 602706 - DNA, 487 bp, Homo sapiens; identical to SEQ ID NO: 560025
  misc_feature: HIJSMM301DTAOR.13.87.H10.1.454.light.4.raw

SEQ ID NO: 602707 - DNA, 503 bp, Homo sapiens
  misc_feature: HIJSMM301CSDN0.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtcctgggtcagcccaaggctgccccctcggtcta

SEQ ID NO: 602708 - DNA, 475 bp, Homo sapiens; identical to SEQ ID NO: 542145
  misc_feature: HIJSMM301EU1FU.40.59.F04.1.454.light.4.raw

SEQ ID NO: 602709 - DNA, 509 bp, Homo sapiens
  misc_feature: HIJSMM301BLO3B.17.28.C06.1.454.light.4.raw
  modified_base (463)..(463): a, c, t, g, unknown or other
cgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgatcctcatctatagaaatgatcatcggccctccggggtccctgaccgattctctggctccatgtctggcacctcagcctccctgaccatcagtgggctccggtcgaggatgaggctgattattactgtgcaccgtgggatgacatcctgaatggtccggtggttccggnggagggaccaggctgaccgtcctaagtcagcccaaggctgcccccc

SEQ ID NO: 602710 - DNA, 503 bp, Homo sapiens; identical to SEQ ID NO: 535044
  misc_feature: HIJSMM301E2KYP.19.78.H01.1.454.light.4.raw

SEQ ID NO: 602711 - DNA, 496 bp, Homo sapiens; identical to SEQ ID NO: 536248
  misc_feature: HIJSMM301E1D9B.22.27.C05.1.454.light.4.raw

SEQ ID NO: 602712 - DNA, 505 bp, Homo sapiens
  misc_feature: HIJSMM301DJVNV.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcaccgggacgcaacatgggatgacaatctgagcggttgggtgttacggcggagggaccaaactgaccgtcctaggtcagcccgaa

SEQ ID NO: 602713 - DNA, 484 bp, Homo sapiens
  misc_feature: HIJSMM301A20DS.48.19.B08.1.454.light.4.raw
agtatacatacacgaccggtgctcgatttagtgagtcagtaaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacacttgggtgttcggcggaggggaccaaggctgaccgtcctaggtcagcccaa

SEQ ID NO: 602714 - DNA, 485 bp, Homo sapiens
  misc_feature: HIJSMM301BCQ8W.26.70.G04.1.454.light.4.raw
agactatactcacgaccggtgctcgatttagtgtagtgtgaagggaaagggggcaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgtcgggcgagtcagggcattagcgattttttagcctggtttcagcagaaaccagggaaagcccccaagtccctgatctatgctgcgtccactttagaaggtggagtcccatcaaggttcagcggcagtggatctgggacagagttcactctcaacatcagcagcctgcagcctgaggattttgcaacttattactgccagcagtataatgatttacccatcaccttcggccgggggacacggctggaaactaaacgaactgtggctgcacc

SEQ ID NO: 602715 - DNA, 497 bp, Homo sapiens
  misc_feature: HIJSMM301A34NM.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccagggtggagatcaaacgaactgtggctgcaccatctgtcttcta

SEQ ID NO: 602716 - DNA, 495 bp, Homo sapiens; identical to SEQ ID NO: 569639
  misc_feature: HIJSMM301BJ457.10.20.B09.1.454.light.4.raw

SEQ ID NO: 602717 - DNA, 503 bp, Homo sapiens
  misc_feature: HIJSMM301AV59Q.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccccc

SEQ ID NO: 602718 - DNA, 499 bp, Homo sapiens
  misc_feature: HIJSMM301B64N1.51.27.C05.1.454.light.4.raw
cgatcgtatacacgaccggtgctcgatttagacgcgatcgaagggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcaggggacaacggtcacattggccatcagtggagtccaggcagaggacgaggctgactattattgtcaatcaacagacaccaattggtacttatgtcttcggaactgcgacaaggtcaccgtcctgggtcagcccaaggccaacccactgtcactctcg

SEQ ID NO: 602719 - DNA, 489 bp, Homo sapiens; identical to SEQ ID NO: 542296
  misc_feature: HIJSMM301CMDK8.17.21.B10.1.454.light.4.raw

SEQ ID NO: 602720 - DNA, 514 bp, Homo sapiens; identical to SEQ ID NO: 545978
  misc_feature: HIJSMM301ENB52.17.33.C11.1.454.light.4.raw

SEQ ID NO: 602721 - DNA, 504 bp, Homo sapiens
  misc_feature: HIJSMM301DEYXL.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactatggctgcaccatctgtcttcatcttcccgc

SEQ ID NO: 602722 - DNA, 489 bp, Homo sapiens; identical to SEQ ID NO: 578292
  misc_feature: HIJSMM301CT61H.3.55.E11.1.454.light.4.raw

SEQ ID NO: 602723 - DNA, 477 bp, Homo sapiens
  misc_feature: HIJSMM301EK1YX.4.14.B03.1.454.light.4.raw
agcactgtagcacgaccggtgctcgatttagtgtgagtagttccgcgggggcaggagtcagactcagtcaggacacagcatggacatgagggtccccgctcagctcctggggctcctgctgctctggctcccaggtgccagatgtgacatccaaatgacccagtctccttccaccctgtctgcatctgtgggagacagagtcactatcacttgccgggccagtcagagcattagtggctggctggcctggtatcagcagaaaccagggagagcccctaagctcttgatctttgatgccaccaatttggaaagtggggtcccatcaagattcagcggcagtggatttgggacagaattcactctcaccatcagcagcctgcagcctggtgattttgcaacttattactgccaacagtataatagttattctctcactttcggtcggagggaccgaaggtggagatcaaacgaactagt

SEQ ID NO: 602724 - DNA, 494 bp, Homo sapiens; identical to SEQ ID NO: 534992
  misc_feature: HIJSMM301D2DNZ.9.1.A01.1.454.light.4.raw

SEQ ID NO: 602725 - DNA, 497 bp, Homo sapiens
  misc_feature: HIJSMM301BF61K.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggaccaaggtggagttcaaacgaactgtggctgcaccatctgtcttcattccc

SEQ ID NO: 602726 - DNA, 501 bp, Homo sapiens
  misc_feature: HIJSMM301B4ZX3.52.55.E11.1.454.light.4.raw
cgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgtctccaggggggagagccaccctctcctgcagggccagtcagagtgttggcaacctcttagcctggtaccaacaaaaacctggccaggctcccaggctcctcatctatgatgcatccacgagggccactggcatcccagccaggttcagtggcagtgggtctgagacagacttcactctcaccatcagtggcctcgagcctgaagattttgcagtttattactgtcagcagcgtagccactggctctctttcggcggagggaccaaggttgagatacaaacgaactgtggctgcacatctgtcttcatcttccccg

SEQ ID NO: 602727 - DNA, 483 bp, Homo sapiens
  misc_feature: HIJSMM301AU9S8.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctggaccaggtcaccgtcctaggtcagcccaaggccaa

SEQ ID NO: 602728 - DNA, 501 bp, Homo sapiens
  misc_feature: HIJSMM301D53IB.12.50.E06.1.454.light.4.raw
atacgacgtacacgaccggtgctcgatttagatctactgacaacacacaaggggggagaagagctgctcagttaggacccagagggaaccatggaaaccccagcgcagcttctcttcctcctgctactctggctcccagataccaccggagaaattgtgttgacgcagtctccaggcaccctgtctttgtctccgggggaaagagtcaccctctcctgcagggccagtcagagtgttagcggcaactacttagcctggtaccaacagaaacctggccaggctcccaggctcgtcatctatggtgcatccagcagggccactggcatcccagacaggttcagtggcagtgggtctgggacagacttcactctcaccatcagtagactggagcctgaagattttgcagtttattactgtcagcagtatgggggctcacgtcgattcactttcggcctggaccaaagtagatgtcaaacgaactgtggctgcaccatctgtctt

SEQ ID NO: 602729 - DNA, 503 bp, Homo sapiens; identical to SEQ ID NO: 595183
  misc_feature: HIJSMM301ADQ62.19.78.H01.1.454.light.4.raw

SEQ ID NO: 602730 - DNA, 443 bp, Homo sapiens; identical to SEQ ID NO: 544913
  misc_feature: HIJSMM301EU4AF.5.9.A09.1.454.light.4.raw

SEQ ID NO: 602731 - DNA, 505 bp, Homo sapiens
  misc_feature: HIJSMM301CDDS3.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcaggtgggtcaggcactgatttcacactggaaatcagcagggtggaggctgaggatggttggggtttattactgcatgcaaactacacacggccgctcactttcggcggagggaccaaggtggagatcaaacgaactgtggctgcaccatct

SEQ ID NO: 602732 - DNA, 491 bp, Homo sapiens; identical to SEQ ID NO: 535176
  misc_feature: HIJSMM301DB588.13.39.D06.1.454.light.4.raw

SEQ ID NO: 602733 - DNA, 494 bp, Homo sapiens
  misc_feature: HIJSMM301C2BWU.10.2.A02.1.454.light.4.raw
catagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgtagtctgaagattttgcagtttattactgtcagcagtatgatacctggcctccgtacacttttggccgggggaccaaggctggaaatcaagcgaactgtggctgcaccatctgtcttcatt

SEQ ID NO: 602734 - DNA, 486 bp, Homo sapiens; identical to SEQ ID NO: 557485
  misc_feature: HIJSMM301C42IY.17.21.B10.1.454.light.4.raw

SEQ ID NO: 602735 - DNA, 495 bp, Homo sapiens; identical to SEQ ID NO: 554164
  misc_feature: HIJSMM301A2Q67.27.78.H01.1.454.light.4.raw

SEQ ID NO: 602736 - DNA, 501 bp, Homo sapiens; identical to SEQ ID NO: 542488
  misc_feature: HIJSMM301ETRWJ.19.78.H01.1.454.light.4.raw

SEQ ID NO: 602737 - DNA, 484 bp, Homo sapiens; identical to SEQ ID NO: 537878
  misc_feature: HIJSMM301CVWSN.17.34.D01.1.454.light.4.raw

SEQ ID NO: 602738 - DNA, 511 bp, Homo sapiens
  misc_feature: HIJSMM301EUXP3.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggtagggaccaaggctgaccgtcttaagtcagcccaaggctgccccctcggtcactctgttccca

SEQ ID NO: 602739 - DNA, 473 bp, Homo sapiens
  misc_feature: HIJSMM301DHS0N.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagatttaatttcaccatcagcagcctccaacgtgatgatgttgcaacatactattgtcagcaatatgattttgctcctccgagtgccacttttggcggggggaccaaggtggacatcaaacgaact

SEQ ID NO: 602740 - DNA, 522 bp, Homo sapiens
  misc_feature: HIJSMM301BFPAQ.43.12.B01.1.454.light.4.raw
tgtgagtagtcacgaccggtgctcgatttagtagtgtagattccgcggggggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttgggggcaaagctgccctgacactgtcaggtgtgcaccctgaggacgaggctgagtattactgtctgctccactttcgtactgcctgggtcttcggcgggggactcagttgaccgtcctaggtcagcccaaggctcgccccctcggtcactctcgttcccaccctcctccactactca

SEQ ID NO: 602741 - DNA, 483 bp, Homo sapiens
  misc_feature: HIJSMM301BQ4IS.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactacccctctcactttcggcgaggggaccgaaggtggagatacaaacgaactgtggctgcta

SEQ ID NO: 602742 - DNA, 483 bp, Homo sapiens
  misc_feature: HIJSMM301EMWG0.40.1.A01.1.454.light.4.raw
tctagcgactcacgaccggtgctcgatttagacgtctcatcagggggcaggagtcagtcccaaccaggacacagcatggacatgagggtccctgctcagctcctggggctcctgctgctctggctctcaggtgccagatgtgacatccagctgacccagtctccatcctccctgtctgcatctgttggagacagagtcaccatcacttgccaggcgagtcaggacattagtaaatatttgaattggtatcaacaaaaaccagggaaagcccctaagctcctgatctacgatgcatctaagttggaaacaggggtctcatcaaggttcagtggaagtggatctgggacagatcctactttctaccatcagcagcctgcagccacgaagatattgcgacatatttctgtcaggtgtatgaaagtctccctgtttttggtccaggggaccgaaggtaggagatcaaacgaactagtggctgcacca

SEQ ID NO: 602743 - DNA, 508 bp, Homo sapiens
  misc_feature: HIJSMM301CPQFZ.13.3.A03.1.454.light.4.raw
  modified_base (408)..(408): a, c, t, g, unknown or other
tcacgtactacacgaccggtgctcgatttagagagcgtcacagggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaactcattatttacggggtcaataagcggccctcagggctttctgatcgcttctctggctccaagtctggcaacacggcctccctgacaatctctggactccaggccgaggacgaggctgatttttacngttgttcatatgcaggaaggagtgattatgtctttggaagtgggaccaaggtcaccgtccttggtcagcccaaggccaacccactgtcactctgttcccg

SEQ ID NO: 602744 - DNA, 444 bp, Homo sapiens; identical to SEQ ID NO: 534993
  misc_feature: HIJSMM301C1MR6.5.9.A09.1.454.light.4.raw

SEQ ID NO: 602745 - DNA, 502 bp, Homo sapiens
  misc_feature: HIJSMM301DOLHL.47.83.H06.1.454.light.4.raw
agctcacgtacacgaccggtgctcgatttagatcacgtgcgtcgcgggggaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctgggtccctgatcgcttctctggttccatccttgggaacaaagctgccctcaccatcgcggggcccaggcagatgatgagtgtgattattactgtgtgctctatatgggcagtggcgtttgggtgttcggcggaggaccaagctgaccgtcg

SEQ ID NO: 602746 - DNA, 454 bp, Homo sapiens; identical to SEQ ID NO: 536449
  misc_feature: HIJSMM301ANW45.18.78.H01.1.454.light.4.raw

SEQ ID NO: 602747 - DNA, 467 bp, Homo sapiens; identical to SEQ ID NO: 537890
  misc_feature: HIJSMM301EVBC3.3.68.G02.1.454.light.4.raw

SEQ ID NO: 602748 - DNA, 504 bp, Homo sapiens
  misc_feature: HIJSMM301B5WR5.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcttcggccaagggaccaaggtggaaagtacaaacgaactagtggctgcaccatctgtcttcatcttccccg

SEQ ID NO: 602749 - DNA, 505 bp, Homo sapiens
  misc_feature: HIJSMM301CVPE1.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccagggaccaaggtggaaatacaaacgaactagtggctgcaccactctgtcttctatcttccccg

SEQ ID NO: 602750 - DNA, 503 bp, Homo sapiens
  misc_feature: HIJSMM301A2DBB.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtctaagtcagcccaaggccaaccctct

SEQ ID NO: 602751 - DNA, 494 bp, Homo sapiens
  misc_feature: HIJSMM301EHVE5.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaaacaccttcggccaagggacacgactggagattaaaggaactgtggctgcacatctgtcttcatcttccccg

SEQ ID NO: 602752 - DNA, 491 bp, Homo sapiens
  misc_feature: HIJSMM301A0H5O.14.53.E09.1.454.light.4.raw
cgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgcttttttggtaccagcagaagccaggccaggcccctctcttgattatatataaggacactgagaggccctcagggatccctgagcgattctctgactccagctcagggacaacactcaccttgaccatcagtgcagtccaggcagaagacgaggctgactattattgtcaatcagcagtcagcactaattcttatcgggtgttcggcggagggaccaaggctgaccgtcctacggtcagcccaaggctgccccctccggtctacc

SEQ ID NO: 602753 - DNA, 495 bp, Homo sapiens; identical to SEQ ID NO: 535596
  misc_feature: HIJSMM301DD8DZ.10.79.H02.1.454.light.4.raw

SEQ ID NO: 602754 - DNA, 510 bp, Homo sapiens
  misc_feature: HIJSMM301CT60K.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgctagtttattactgtcaacatcgtaccgagtggcctccgggggccactttcggccctgggaccaaagtggatatacaaacgaactgtggctgcaccatctgtcttcta

SEQ ID NO: 602755 - DNA, 509 bp, Homo sapiens; identical to SEQ ID NO: 542213
  misc_feature: HIJSMM301EQE9N.17.41.D08.1.454.light.4.raw

SEQ ID NO: 602756 - DNA, 503 bp, Homo sapiens; identical to SEQ ID NO: 558371
  misc_feature: HIJSMM301AT690.12.67.G01.1.454.light.4.raw

SEQ ID NO: 602757 - DNA, 512 bp, Homo sapiens
  misc_feature: HIJSMM301B7LF4.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagcctgcctccgtgtctgagtctcttggacagtcgatcaccatctcctccactgggaccggtcgtgatgttgggacttatacccttgtctcctggtaccaacaataccccggcaaagcccccaaactcctgatttatgaggctcataagcggccctcaggggtttctgagcgcttctctggctccagggctgacaacacggcctacctgacgatctctgggctccaggctgaggacgaggctgactattattgctgcgcatacgcaggaagtagcacatgggtgtgcggcggagggaccaaggtgaccgtcctgggtcagcccaaggctgccccctcggtcactctcg

SEQ ID NO: 602758 - DNA, 520 bp, Homo sapiens; identical to SEQ ID NO: 535686
  misc_feature: HIJSMM301CQ0QZ.41.19.B08.1.454.light.4.raw

SEQ ID NO: 602759 - DNA, 478 bp, Homo sapiens
  misc_feature: HIJSMM301CAJXV.48.26.C04.1.454.light.4.raw
agtatacatacacgaccggtgctcgatttagtctagcgactttgggtttgggggaggatacgcgtgacagataagaagggctggtgggatcagtcctggtggtagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctctggggtccccgatcggttctctggctccatcgacaggtcctccaactctgcctctctcaccatctctggactgcagactgaggacgaggctgattactactgtcagtcttatgat

SEQ ID NO: 602760 - DNA, 469 bp, Homo sapiens; identical to SEQ ID NO: 536091
  misc_feature: HIJSMM301CF8G4.3.82.H05.1.454.light.4.raw

SEQ ID NO: 602761 - DNA, 494 bp, Homo sapiens; identical to SEQ ID NO: 534992
  misc_feature: HIJSMM301A95VT.9.1.A01.1.454.light.4.raw

SEQ ID NO: 602762 - DNA, 486 bp, Homo sapiens; identical to SEQ ID NO: 535043
  misc_feature: HIJSMM301EGACB.46.35.D02.1.454.light.4.raw

SEQ ID NO: 602763 - DNA, 501 bp, Homo sapiens
  misc_feature: HIJSMM301DE8VR.9.71.G05.1.454.light.4.raw
tgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaagggtgaccggtcctaggtcagcccaaggctccg

SEQ ID NO: 602764 - DNA, 486 bp, Homo sapiens; identical to SEQ ID NO: 542999
  misc_feature: HIJSMM301EDL7Q.17.55.E11.1.454.light.4.raw

SEQ ID NO: 602765 - DNA, 508 bp, Homo sapiens
  misc_feature: HIJSMM301EKWUS.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgccaggaccgaacggtggaagtacaaacgaactagtggctgcaccactctgtcttctactcttcccgccact

SEQ ID NO: 602766 - DNA, 490 bp, Homo sapiens
  misc_feature: HIJSMM301DKK7Z.2.34.D01.1.454.light.4.raw
acgctcgacacacgaccggtgctcgatttagatcgtctgtgttgggtttgggggctttgcctgggctctgctcctcctcaccctcctcactcagggcacagggtcctgggcccagtctgccctgactcagccccctccgcgtccgggtctcctggacagtcagtcaccatctcctgcactggaatcagcagtgacctgagtccttataactatgtctcctggtaccaacaacacccaggcaaagcccccaaactcattatttatgaagtcactaagcggccctcaggggtccctgatcgcttctctggctccaagtctggcgagacggcctccctgaccgtctctgggctccaggctgaagatgaggctgattatactgcagctcatatgcaggcagcaacaatgtggcattcggcgagggaccaagctgaccgtctggtcagcccaaggctgcccctcggtcactctgttccacctctctgtcgagcgt

SEQ ID NO: 602767 - DNA, 502 bp, Homo sapiens
  misc_feature: HIJSMM301E1I9Y.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaaacagggccactggcatcccagacaggttcagtggcagtgggtctgggacagacttcactctcaccatcagcagactggagcctgaggattttgcagtgtattactgtcagcagtatcataggtcaaaacaccttcggccaagggacacgactggagaattaaaaggaactagtggcgtgcaccaatctgtcttctatcttccccg

SEQ ID NO: 602768 - DNA, 496 bp, Homo sapiens; identical to SEQ ID NO: 537513
  misc_feature: HIJSMM301D9YLF.12.87.H10.1.454.light.4.raw

SEQ ID NO: 602769 - DNA, 509 bp, Homo sapiens; identical to SEQ ID NO: 553073
  misc_feature: HIJSMM301ED3JN.16.1.A01.1.454.light.4.raw

SEQ ID NO: 602770 - DNA, 496 bp, Homo sapiens; identical to SEQ ID NO: 536802
  misc_feature: HIJSMM301C319G.5.24.C02.1.454.light.4.raw

SEQ ID NO: 602771 - DNA, 505 bp, Homo sapiens
  misc_feature: HIJSMM301CAZRK.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtctaggtcagcccaaggccaacccactgtcta

SEQ ID NO: 602772 - DNA, 505 bp, Homo sapiens; identical to SEQ ID NO: 547532
  misc_feature: HIJSMM301B6XF7.8.1.A01.1.454.light.4.raw

SEQ ID NO: 602773 - DNA, 502 bp, Homo sapiens; identical to SEQ ID NO: 543913
  misc_feature: HIJSMM301BKGWC.18.26.C04.1.454.light.4.raw

SEQ ID NO: 602774 - DNA, 484 bp, Homo sapiens; identical to SEQ ID NO: 535400
  misc_feature: HIJSMM301EYGVQ.46.26.C04.1.454.light.4.raw

SEQ ID NO: 602775 - DNA, 510 bp, Homo sapiens; identical to SEQ ID NO: 565789
  misc_feature: HIJSMM301CHJIP.11.57.F02.1.454.light.4.raw

SEQ ID NO: 602776 - DNA, 488 bp, Homo sapiens; identical to SEQ ID NO: 535990
  misc_feature: HIJSMM301B3K7B.11.28.C06.1.454.light.4.raw

SEQ ID NO: 602777 - DNA, 505 bp, Homo sapiens
  misc_feature: HIJSMM301D2YNY.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatattgcagtttattactgtcaacatcgtaccgagtggcctccgggggccactttcggccctgggaccaaagtggatatcaaacgaactgtggctgcaccatctgtctt

SEQ ID NO: 602778 - DNA, 447 bp, Homo sapiens; identical to SEQ ID NO: 535201
  misc_feature: HIJSMM301DYMU6.18.9.A09.1.454.light.4.raw

SEQ ID NO: 602779 - DNA, 493 bp, Homo sapiens
  misc_feature: HIJSMM301DABBV.27.78.H01.1.454.light.4.raw
  modified_base (462)..(462): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactgganattaaacgaactgtggctgcacatctgtctt

SEQ ID NO: 602780 - DNA, 478 bp, Homo sapiens; identical to SEQ ID NO: 535129
  misc_feature: HIJSMM301BIM8A.11.11.A11.1.454.light.4.raw

SEQ ID NO: 602781 - DNA, 488 bp, Homo sapiens
  misc_feature: HIJSMM301BPG1C.52.25.C03.1.454.light.4.raw
cgcagtacgacacgaccggtgctcgatttagtagtgtagatttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatggtgcatcaactttgcaaggtggggtcccatcaaggttcagcggcagtggatctgggacagaattcactctcacaatcagcagcctgcagcctgaagattttgcaacttattactgtcaacaccttaatagttactccttcactttcggccctggaccaaagtggacatcaaacgaactgtggctgcaccatctgtcttcta

SEQ ID NO: 602782 - DNA, 464 bp, Homo sapiens; identical to SEQ ID NO: 583849
  misc_feature: HIJSMM301EH50F.10.9.A09.1.454.light.4.raw

SEQ ID NO: 602783 - DNA, 494 bp, Homo sapiens; identical to SEQ ID NO: 541159
  misc_feature: HIJSMM301DDM5Q.15.59.F04.1.454.light.4.raw

SEQ ID NO: 602784 - DNA, 496 bp, Homo sapiens
  misc_feature: HIJSMM301BXJ3G.22.27.C05.1.454.light.4.raw
acatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctcctcagacgttcgaccaagggaccaaggtggaaatcaaacgaactgtggctgcacc

SEQ ID NO: 602785 - DNA, 480 bp, Homo sapiens; identical to SEQ ID NO: 535630
  misc_feature: HIJSMM301DMXER.40.59.F04.1.454.light.4.raw

SEQ ID NO: 602786 - DNA, 512 bp, Homo sapiens
  misc_feature: HIJSMM301D1I91.40.12.B01.1.454.light.4.raw
tctagcgactcacgaccggtgctcgatttagtagtgtagattccgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttatttttgctgctcttatgcaggcagtttcgctctcgaagtgttcggcggagggaccgagctgaccgtcctacgtcagcccaaggctgccccctcggtcactctcg

SEQ ID NO: 602787 - DNA, 463 bp, Homo sapiens; identical to SEQ ID NO: 535008
  misc_feature: HIJSMM301BD7GC.10.9.A09.1.454.light.4.raw

SEQ ID NO: 602788 - DNA, 514 bp, Homo sapiens
  misc_feature: HIJSMM301DZU8S.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtagggaaatacgaaacgaaactagtaggctcggcaccatctgtcttcatctttcccccg

SEQ ID NO: 602789 - DNA, 500 bp, Homo sapiens
  misc_feature: HIJSMM301BTDBY.41.14.B03.1.454.light.4.raw
tctatactatcacgaccggtgctcgatttagtgtgagtagttccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagcccaaggctgcccctc

SEQ ID NO: 602790 - DNA, 416 bp, Homo sapiens
  misc_feature: HIJSMM301BBS7V.18.78.H01.1.454.light.4.raw
tacgagtatgcacgaccggtgctcgatttagtgtgagtagtttgggtttgggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaacccctctgtcactctgttcccgccctcctccatactcgta

SEQ ID NO: 602791 - DNA, 504 bp, Homo sapiens; identical to SEQ ID NO: 585508
  misc_feature: HIJSMM301APHWP.14.57.F02.1.454.light.4.raw

SEQ ID NO: 602792 - DNA, 485 bp, Homo sapiens
  misc_feature: HIJSMM301AZ7LH.4.54.E10.1.454.light.4.raw
agcactgtagcacgaccggtgctcgatttagatcgtagcagaacacacaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcagcatcacttgccgggcaagtcagagcattagctacttttttaagttggtatcagcagacaccagggaaacgcccctaagctcctgatctatgctgcttccagtttgcaaagtggggtcccatcaaggttcagtggcagtggatctgggacagatttcactctcactgtcagcagtctgctaatttgaagtattttgctaactttactactgtcaacagtagtttcagtatcccttggactttcggccaagggaccaaggtgaaatacaaacgaactagtgg

SEQ ID NO: 602793 - DNA, 486 bp, Homo sapiens
  misc_feature: HIJSMM301B81B2.52.59.F04.1.454.light.4.raw
cgcagtacgacacgaccggtgctcgatttagtacacacacttagggattggggagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactatttaaattggtatcagcagaaaccagggaaagcccctaaactcctgatctacgatgcatccaatttggagacaggggtcccatcaaggttcactggaagtggatctgggacacattttactttcaccatcagcggcctgcagcctgaagattttgcaacatattactgtcaacaatatgaagatctccccctcactttcggcggagggaccaaggtggagatcagacgaactgtggctgcaccatctgtctt

SEQ ID NO: 602794 - DNA, 485 bp, Homo sapiens
  misc_feature: HIJSMM301E4BVA.40.83.H06.1.454.light.4.raw
tctagcgactcacgaccggtgctcgatttagatcacgtgcgtcgcggggcaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatggacggcagcctcagtgaatgggtgttcggcggagggaccaaactagtccgtcctacggtcagcccg

SEQ ID NO: 602795 - DNA, 474 bp, Homo sapiens; identical to SEQ ID NO: 561309
  misc_feature: HIJSMM301CMDGE.5.12.B01.1.454.light.4.raw

SEQ ID NO: 602796 - DNA, 494 bp, Homo sapiens; identical to SEQ ID NO: 534994
  misc_feature: HIJSMM301EC6GD.27.78.H01.1.454.light.4.raw

SEQ ID NO: 602797 - DNA, 493 bp, Homo sapiens; identical to SEQ ID NO: 536246
  misc_feature: HIJSMM301DKAMM.49.66.F11.1.454.light.4.raw

SEQ ID NO: 602798 - DNA, 492 bp, Homo sapiens
  misc_feature: HIJSMM301CMH1D.5.57.F02.1.454.light.4.raw
atcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggaaagagccaccctctcctgcagggccagccagagtgtaagtagtaggttagcctggtatcagcagaaacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcaacagtataatgactggtggacgttcggccaagggaccaggtaggagaccaacgaactgtggctgcaccatctgtcttcta

SEQ ID NO: 602799 - DNA, 422 bp, Homo sapiens; identical to SEQ ID NO: 543437
  misc_feature: HIJSMM301BRW56.9.25.C03.1.454.light.4.raw

SEQ ID NO: 602800 - DNA, 516 bp, Homo sapiens; identical to SEQ ID NO: 586396
  misc_feature: HIJSMM301D80KY.12.85.H08.1.454.light.4.raw

SEQ ID NO: 602801 - DNA, 485 bp, Homo sapiens; identical to SEQ ID NO: 535501
  misc_feature: HIJSMM301AXQ56.3.10.A10.1.454.light.4.raw

SEQ ID NO: 602802 - DNA, 488 bp, Homo sapiens
  misc_feature: HIJSMM301D3MFP.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagttggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtggggctgaggatgttggcatttattactgcatgcaggctatacaccttcctgccacttttggccaggggaccaagctggagatcaggcgtaacg

SEQ ID NO: 602803 - DNA, 515 bp, Homo sapiens
  misc_feature: HIJSMM301BTWO9.43.23.C01.1.454.light.4.raw
tgtgagtagtcacgaccggtgctcgatttagtacacgtgattagggattggggggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcgggggcaaagctgccctgacactgtcaggtgtgcagcctgaggacgaggctgactattactgcctgctcatatatggtggcgcgtgggtgttcggcggagggaccaagctgaccgtcctgggtcagcccaaggctgccccctcggtcactctgttcccacctcctca

SEQ ID NO: 602804 - DNA, 416 bp, Homo sapiens; identical to SEQ ID NO: 536892
  misc_feature: HIJSMM301BSH6J.16.46.E02.1.454.light.4.raw

SEQ ID NO: 602805 - DNA, 489 bp, Homo sapiens; identical to SEQ ID NO: 535139
  misc_feature: HIJSMM301E3EYH.14.55.E11.1.454.light.4.raw

SEQ ID NO: 602806 - DNA, 498 bp, Homo sapiens
  misc_feature: HIJSMM301BOXJN.18.59.F04.1.454.light.4.raw
tacgagtatgcacgaccggtgctcgatttagtacacacacttagggattggggagagaagacaggattcaggacaatctccagcatggccggcttccctctcctcctcaccctcctcactcactgtgcagggtcctgggcccagtctgtgctgactcagccaccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaaccct

SEQ ID NO: 602807 - DNA, 494 bp, Homo sapiens; identical to SEQ ID NO: 556762
  misc_feature: HIJSMM301DVJ2Z.43.83.H06.1.454.light.4.raw

SEQ ID NO: 602808 - DNA, 504 bp, Homo sapiens
  misc_feature: HIJSMM301BRAEE.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcgagggaccaaggtggacctcaaacgaactgtggctgcaccatctgtcttcatcttcccgcc

SEQ ID NO: 602809 - DNA, 504 bp, Homo sapiens
  misc_feature: HIJSMM301ASLBV.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctggagcggttgggtgttcggcggagggaccaaactgaccgttcctaggtcagcccaa

SEQ ID NO: 602810 - DNA, 512 bp, Homo sapiens
  misc_feature: HIJSMM301DCBWQ.7.34.D01.1.454.light.4.raw
cgtgtctctacacgaccggtgctcgatttagatcgtctgtgttgggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacagcattatttgggtgttcggcggagggaccaagctgaccgtcctgcgtcagcccaaggctcgccccctcggtcact

SEQ ID NO: 602811 - DNA, 504 bp, Homo sapiens
  misc_feature: HIJSMM301CE55V.14.35.D02.1.454.light.4.raw
cgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtaccaacagaaaccaggacagtctcctaagttgctcattttctgggcatctacccgggaatccggggtccctgagcgattcagtggcagcgggtctgggacagatttcactttcaccatcagcagcctgcaggctgaagatgtggcagtttattactgtcagcaatattatagtactccctactacttttggccgaggggaccaagctggagatcaaacgaactagtggctgcaccta

SEQ ID NO: 602812 - DNA, 479 bp, Homo sapiens; identical to SEQ ID NO: 542895
  misc_feature: HIJSMM301ANICI.40.59.F04.1.454.light.4.raw

SEQ ID NO: 602813 - DNA, 492 bp, Homo sapiens
  misc_feature: HIJSMM301AJQVU.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgctaacttatttttgtcaacaggctaacactttcccctcactttcggcggagggaccgaaggtggagatcaagcgaactgtggctgcaccatctgtctt

SEQ ID NO: 602814 - DNA, 513 bp, Homo sapiens
  misc_feature: HIJSMM301ESAYM.10.75.G09.1.454.light.4.raw
catagtagtgcacgaccggtgctcgatttagtatagacatcaggggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaagtgacattggttctttaaattttgtctcttggtaccaacagagcccagacaaagcccccaaaattatcatttctgctgtcagtaatcggccctcaggggtttctagtcgcttctctggctccaagtctggcaacacggcctccctgaccatctctgggctccaggctgaggacgaggctgattattattgcagctcatatacaaacaccaaaagctttgatattcgggcggagggaccaaactgaccgtccttcgtcagcccaaggctgccccctcggtccactctgttcccg

SEQ ID NO: 602815 - DNA, 490 bp, Homo sapiens
  misc_feature: HIJSMM301ED3EL.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagattacaattaccctcggacgttcggccaggggaccaaggtggaaatacaaacgaacctagtggctgcacca

SEQ ID NO: 602816 - DNA, 497 bp, Homo sapiens
  misc_feature: HIJSMM301ENN5N.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctctttggaactgggaccacggtcaccgtcctaggtcagccccaaggccaacccca

SEQ ID NO: 602817 - DNA, 455 bp, Homo sapiens; identical to SEQ ID NO: 535447
  misc_feature: HIJSMM301DZVRF.19.71.G05.1.454.light.4.raw

SEQ ID NO: 602818 - DNA, 492 bp, Homo sapiens
  misc_feature: HIJSMM301DG2MU.15.28.C06.1.454.light.4.raw
tctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcagcggcagtggatctgggacagaattcagtctcaccatcagcagcctgcagcctgacgattttgcaacttactactgccaagtgcataataatcatttcggcggaggaccgaaggtggagatacaaacgaactagtggctgcaccatctgttcttcattccc

SEQ ID NO: 602819 - DNA, 514 bp, Homo sapiens
  misc_feature: HIJSMM301ADXY7.7.21.B10.1.454.light.4.raw
cgtgtctctacacgaccggtgctcgatttagtgtcgtcgcaagagaggaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggccgtccgggggccaccgtttcggtcccgtcgggaccgaaagtggatatacaaacgaactgtggctgcaccatctgtctt

SEQ ID NO: 602820 - DNA, 483 bp, Homo sapiens; identical to SEQ ID NO: 535413
  misc_feature: HIJSMM301ATIRI.26.78.H01.1.454.light.4.raw

SEQ ID NO: 602821 - DNA, 493 bp, Homo sapiens; identical to SEQ ID NO: 548342
  misc_feature: HIJSMM301EHCSF.27.78.H01.1.454.light.4.raw

SEQ ID NO: 602822 - DNA, 504 bp, Homo sapiens
  misc_feature: HIJSMM301EMZFQ.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgtcctgactcagcctgcctccgtagtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacgacctccctgaccatctctgggctccaggctgatgacgaggctgattattactgcaggtcatatacaatcagcaacacttatgtcttcgggactgggaccaagatcaccgtcctaggtcagcccaaggccaacccccatgtcta

SEQ ID NO: 602823 - DNA, 483 bp, Homo sapiens
  misc_feature: HIJSMM301D4I5U.17.39.D06.1.454.light.4.raw
  modified_base (199)..(199): a, c, t, g, unknown or other
cgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttggcagcaacttagcctggtatcagcagaaacctggccaggctcccaggctcctcatgtatggtgcatctaccagggccactggtgtcccagccaggttcagtggcagtgggtctgggacagagttctctctcatcatcagcagcctgcagtctgaagattttgcggtttattactgtcagcagtataatcagtggcctccgtggacgttcggccgaaggaccgaaggtaggaagtacaaacgaactgtgg

SEQ ID NO: 602824 - DNA, 492 bp, Homo sapiens; identical to SEQ ID NO: 535126
  misc_feature: HIJSMM301B7FKG.18.11.A11.1.454.light.4.raw

SEQ ID NO: 602825 - DNA, 441 bp, Homo sapiens; identical to SEQ ID NO: 534971
  misc_feature: HIJSMM301ETZ26.11.3.A03.1.454.light.4.raw

SEQ ID NO: 602826 - DNA, 485 bp, Homo sapiens; identical to SEQ ID NO: 536040
  misc_feature: HIJSMM301D2MK4.15.1.A01.1.454.light.4.raw

SEQ ID NO: 602827 - DNA, 516 bp, Homo sapiens
  misc_feature: HIJSMM301ALBLT.9.20.B09.1.454.light.4.raw
tgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccgggcccctgtggtggtcgtctatgataacagtgaccggccctcgtcgatccctgagcgcttctctggctccaactctgggaacacggccaccctgaccatcagcagggccgaagccggggatgaggccgactattactgccaggtgtggcatattatcacccccgtgttcggcgggggaccgaagctgaccgtcctaggtcagcccaaggctgccccctcggtcactctgttcccgccctcctcagacgtatcac

SEQ ID NO: 602828 - DNA, 444 bp, Homo sapiens; identical to SEQ ID NO: 534993
  misc_feature: HIJSMM301EYG6J.5.9.A09.1.454.light.4.raw

SEQ ID NO: 602829 - DNA, 502 bp, Homo sapiens
  misc_feature: HIJSMM301AJM4D.41.14.B03.1.454.light.4.raw
tctatactatcacgaccggtgctcgatttagtgtgagtagttccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagccccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagcccaaggctgccccctc

SEQ ID NO: 602830 - DNA, 377 bp, Homo sapiens; identical to SEQ ID NO: 536071
  misc_feature: HIJSMM301BBDMM.40.9.A09.1.454.light.4.raw

SEQ ID NO: 602831 - DNA, 479 bp, Homo sapiens; identical to SEQ ID NO: 537141
  misc_feature: HIJSMM301BNWRS.7.76.G10.1.454.light.4.raw

SEQ ID NO: 602832 - DNA, 498 bp, Homo sapiens
  misc_feature: HIJSMM301A1G08.52.57.F02.1.454.light.4.raw
cgcagtacgacacgaccggtgctcgatttagctcgatatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaaacagacaccattggtacttatgtcttcggaactgcgaccaaaggtcaccgtcctgggtcagcccaaggccaaccccactgtcact

SEQ ID NO: 602833 - DNA, 482 bp, Homo sapiens; identical to SEQ ID NO: 535216
  misc_feature: HIJSMM301A5YM8.17.26.C04.1.454.light.4.raw

SEQ ID NO: 602834 - DNA, 518 bp, Homo sapiens; identical to SEQ ID NO: 539372
  misc_feature: HIJSMM301C2XR4.7.86.H09.1.454.light.4.raw

SEQ ID NO: 602835 - DNA, 466 bp, Homo sapiens; identical to SEQ ID NO: 535366
  misc_feature: HIJSMM301A70Z9.13.4.A04.1.454.light.4.raw

SEQ ID NO: 602836 - DNA, 518 bp, Homo sapiens
  misc_feature: HIJSMM301CJ1V6.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggcccatcagtgggctccggtccgaggatgaggctgattattactgtgcagcatgggatgacagcctgagtggtccttgggtgttcggcggagggaccaagctgaccgtcctaagtcagcccaaggctgccccctcggtccactctgttcccaccctcctccg

SEQ ID NO: 602837 - DNA, 521 bp, Homo sapiens; identical to SEQ ID NO: 539470
  misc_feature: HIJSMM301DSKOV.27.23.C01.1.454.light.4.raw

SEQ ID NO: 602838 - DNA, 520 bp, Homo sapiens
  misc_feature: HIJSMM301CNT7M.27.23.C01.1.454.light.4.raw
agcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctcgttccgccct

SEQ ID NO: 602839 - DNA, 454 bp, Homo sapiens; identical to SEQ ID NO: 536943
  misc_feature: HIJSMM301B5JKC.19.86.H09.1.454.light.4.raw

SEQ ID NO: 602840 - DNA, 494 bp, Homo sapiens
  misc_feature: HIJSMM301BIE2R.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagtagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccaggggaccaagctggagatcaaacgaactgtgg

SEQ ID NO: 602841 - DNA, 494 bp, Homo sapiens
  misc_feature: HIJSMM301DNPPH.3.3.A03.1.454.light.4.raw
agacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagcccaccctctcctgcagggccagtcagagtgttagcagctacttagcctggtatcaacagaaacctggccaggctcccaggctcctcatctatgatgcatccaacagggccactggcatcccagccaggttcagtggcagtgggtctgggacagacttcactctcaccatcagtagcctagagcctgaagattttgcagtctattattgtcaacagcgtggcaactggccctcgtggacgttcggccaagggaccaaggtaggaatacaaccgaactgtggctgcaccatctgtcttcat

SEQ ID NO: 602842 - DNA, 496 bp, Homo sapiens
  misc_feature: HIJSMM301DTK5Q.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtccactctgttcccaccctcctcgagtggtct

SEQ ID NO: 602843 - DNA, 520 bp, Homo sapiens; identical to SEQ ID NO: 546218
  misc_feature: HIJSMM301B5V4Z.12.71.G05.1.454.light.4.raw

SEQ ID NO: 602844 - DNA, 494 bp, Homo sapiens
  misc_feature: HIJSMM301D6K5Z.16.72.G06.1.454.light.4.raw
tgtactactccacgaccggtgctcgatttagctacgactgcaagggaaagggggaggaactgctcagttaggacccagacggaaccatggaagccccagcgcagcttctcttcctcctgctactctggctcccagatacctctggagaaacagtgatgacgcagtctccagccaccctctctgtgtctccaggggaaagagtcaccctctcctgcagggccagtcagagtgttagcagcaacttagcctggtatcagcagaaacctggccaggctcccaggctcctcatctatgatgcatccaccagggccactggtatcccagccaggttcagtggcagtgggtttgggacagagttcactctcaccgtcagcagcctgcagtctgaagattttgcagtttattactgtcagcagtataataactggcctccggtcactttcggcggagggaccaaggtggagatcaaacgaactgtggctgcaccatctgtt

SEQ ID NO: 602845 - DNA, 500 bp, Homo sapiens
  misc_feature: HIJSMM301B06MP.16.86.H09.1.454.light.4.raw
tgtactactccacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtcctaggtcagcccaaggctgcccccc

SEQ ID NO: 602846 - DNA, 506 bp, Homo sapiens; identical to SEQ ID NO: 563474
  misc_feature: HIJSMM301B8G4D.10.27.C05.1.454.light.4.raw

SEQ ID NO: 602847 - DNA, 484 bp, Homo sapiens; identical to SEQ ID NO: 535211
  misc_feature: HIJSMM301B51CV.47.46.E02.1.454.light.4.raw

SEQ ID NO: 602848 - DNA, 494 bp, Homo sapiens; identical to SEQ ID NO: 535629
  misc_feature: HIJSMM301EA30M.4.27.C05.1.454.light.4.raw

SEQ ID NO: 602849 - DNA, 484 bp, Homo sapiens
  misc_feature: HIJSMM301CJMGK.48.40.D07.1.454.light.4.raw
agtatacatacacgaccggtgctcgatttagtgatagagcgtaacaacagaggggctgatcaggactcctcagttcaccttctcacaatgaggctccctgctcagctcctggggctgctaatgctctgggtctctggatccagtggggaaattgtgatgactcagtctccactctccctgcccgtcacccctggagagccggcctccatctcctgcaggtctagtcagagtctcctgcatagtaatggatacaattatttggattggtatttgcagaagccagggcagtctccacagctcctgatctatttgggttctaatcgggcctccggggtccctgacaggttcagtggccatggatcaggcacagatttcacactgaaaatcagcagagtggaggctgaggatgttggagtttactactgcatgcagctctgcatactgctcggacgttcggccgaacgggaccaaggtaggagtaacg

SEQ ID NO: 602850 - DNA, 487 bp, Homo sapiens; identical to SEQ ID NO: 536206
  misc_feature: HIJSMM301CZXK2.47.38.D05.1.454.light.4.raw

SEQ ID NO: 602851 - DNA, 477 bp, Homo sapiens
  misc_feature: HIJSMM301DKPE9.5.15.B04.1.454.light.4.raw
atcagacacgcacgaccggtgctcgatttagacagtatatatccgcgggggtcagactcagtcaggacacagcatggacatgagggtccccgctcagctcctggggctcctgctgctctggctcccaggtgccaaatgtgacatccagatgacccagtctccttccaccctgtctgcatctataggagacagagtcaccatcacttgccgggccagtcagagtattagtaactggttggcctggtatcagcagaaaccaggcaaagccccaaagctccttatctctgatgcctccactttgcacggtggggtcccaccaacgttcagcggcagtggatctgggacagaattcactctcaccatcagcagcctgcagcctgatgatgctgcaacttattactgtcaacaatataacagttattggacgttcggccaagggaccaaggtaggaaatacaaacgaactagtggctgcacc

SEQ ID NO: 602852 - DNA, 520 bp, Homo sapiens; identical to SEQ ID NO: 537173
  misc_feature: HIJSMM301E07ZY.27.23.C01.1.454.light.4.raw

SEQ ID NO: 602853 - DNA, 488 bp, Homo sapiens; identical to SEQ ID NO: 535861
  misc_feature: HIJSMM301EGOZV.14.55.E11.1.454.light.4.raw

SEQ ID NO: 602854 - DNA, 513 bp, Homo sapiens; identical to SEQ ID NO: 539258
  misc_feature: HIJSMM301CZ3NE.43.19.B08.1.454.light.4.raw

SEQ ID NO: 602855 - DNA, 485 bp, Homo sapiens
  misc_feature: HIJSMM301E1IVK.7.75.G09.1.454.light.4.raw
  modified_base (451)..(451): a, c, t, g, unknown or other
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaaccttcggccagggacacgacnggagattaaacgaactgtggctgcaccatctgtt

SEQ ID NO: 602856 - DNA, 493 bp, Homo sapiens; identical to SEQ ID NO: 560592
  misc_feature: HIJSMM301BQCQQ.12.38.D05.1.454.light.4.raw

SEQ ID NO: 602857 - DNA, 510 bp, Homo sapiens
  misc_feature: HIJSMM301AWXRL.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaaggtggaccgtcaaacgaactgtggctgcaccaatctgtcttcatcttcccgccat

SEQ ID NO: 602858 - DNA, 515 bp, Homo sapiens
  misc_feature: HIJSMM301AZ196.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggtccgaacggaccgaacggtaggaaagtacaagacgaactagtggcgtgcaccactactgtcttctatcttcccgt

SEQ ID NO: 602859 - DNA, 527 bp, Homo sapiens
  misc_feature: HIJSMM301CZCVQ.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgtgacttactattgtcaacagagttaccttctcccccggacgttcggccaacggaccgaaggtaggaagtacaagcgaaacgtgtacggcgtcggtcacccaactccttcgttcgttcctacttctttccccgt

SEQ ID NO: 602860 - DNA, 494 bp, Homo sapiens; identical to SEQ ID NO: 551334
  misc_feature: HIJSMM301D0F4F.10.77.G11.1.454.light.4.raw

SEQ ID NO: 602861 - DNA, 486 bp, Homo sapiens; identical to SEQ ID NO: 557950
  misc_feature: HIJSMM301A6OTK.15.1.A01.1.454.light.4.raw

SEQ ID NO: 602862 - DNA, 506 bp, Homo sapiens; identical to SEQ ID NO: 577584
  misc_feature: HIJSMM301CZGMW.5.68.G02.1.454.light.4.raw

SEQ ID NO: 602863 - DNA, 447 bp, Homo sapiens; identical to SEQ ID NO: 535201
  misc_feature: HIJSMM301DN4F9.18.9.A09.1.454.light.4.raw

SEQ ID NO: 602864 - DNA, 496 bp, Homo sapiens
  misc_feature: HIJSMM301CV0XA.48.38.D05.1.454.light.4.raw
agtatacatacacgaccggtgctcgatttagtatctgatagttgggtttgggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgaggctgttcggcggagggaccaagctgaccgtcctaagtcagccaaggctgcccctggtca

SEQ ID NO: 602865 - DNA, 522 bp, Homo sapiens
  misc_feature: HIJSMM301BSLQG.7.21.B10.1.454.light.4.raw
cgtgtctctacacgaccggtgctcgatttagtgtcgtcgcaagagaggaggggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgcagggccagtcagagtgttggcgcctacgtagcctggtaccaacagaaacctggccaggctcccacggcccctcatctatggtgcatccaacagggccactggcatcccagccaggttcagtggcagtgggtctgggacagacttcactctcaccatcatcagcctggagcctgaagatgttgctagtttattactgtcaacatcgtaccgagtggccgtccgggggccaccgtttcggcccgttcgggacccgaaagtaggagtatacaaacgaaacctgtggctgcaccatctgtctt

SEQ ID NO: 602866 - DNA, 521 bp, Homo sapiens; identical to SEQ ID NO: 539470
  misc_feature: HIJSMM301BMONO.27.23.C01.1.454.light.4.raw

SEQ ID NO: 602867 - DNA, 507 bp, Homo sapiens
  misc_feature: HIJSMM301DH0HY.22.46.E02.1.454.light.4.raw
acatacgcgtcacgaccggtgctcgatttagactcatctacagggaaagggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtccgtcaccatctcctgcactgggaccagcagtgatgttggtgcttataactatgtctcctggtaccagcaccacccaggcaaagcccccccaactcttaatttttggtgtcaataaccgccctcaggggtccctgatcgcttctccggctccaagtctggcaacacggcctccctgacccatctctggactccaggctgacgatgagggtgacttttactgctgctcatatgcaggcaactataatatggtcttcggccggagggccaaagtgaccgtcctaggtcagcccaagctgccccctcggtcactc

SEQ ID NO: 602868 - DNA, 499 bp, Homo sapiens; identical to SEQ ID NO: 536578
  misc_feature: HIJSMM301ERHG3.22.27.C05.1.454.light.4.raw

SEQ ID NO: 602869 - DNA, 493 bp, Homo sapiens
  misc_feature: HIJSMM301BUG8K.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatacgaactgactaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaaccaaggtaggataatcagagaa

SEQ ID NO: 602870 - DNA, 493 bp, Homo sapiens; identical to SEQ ID NO: 535047
  misc_feature: HIJSMM301D2C9D.16.53.E09.1.454.light.4.raw

SEQ ID NO: 602871 - DNA, 505 bp, Homo sapiens; identical to SEQ ID NO: 551816
  misc_feature: HIJSMM301ENPL0.18.78.H01.1.454.light.4.raw

SEQ ID NO: 602872 - DNA, 478 bp, Homo sapiens
  misc_feature: HIJSMM301DJ2GD.4.11.A11.1.454.light.4.raw
agcactgtagcacgaccggtgctcgatttagctacgactgcagggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcactatcacctgtcgggccagtcagaatattaatagttggttggcctggtatcaccagagaccaggagaagccccaaagctcatcatttatgatgcctccactttgaatggtggggtcccaccaacgttcagtggcagtggatctgggacagagttcactctcaccatcagcagcctgcagcctgatgatcttggaacttattactgccaacaatataataattattggacgttcggccagggaccaaggtcgaaatgagacgaactgtggctgcaccatctgtt

SEQ ID NO: 602873 - DNA, 491 bp, Homo sapiens; identical to SEQ ID NO: 544714
  misc_feature: HIJSMM301CTIVV.18.11.A11.1.454.light.4.raw

SEQ ID NO: 602874 - DNA, 493 bp, Homo sapiens; identical to SEQ ID NO: 544835
  misc_feature: HIJSMM301EKTMA.43.29.C07.1.454.light.4.raw

SEQ ID NO: 602875 - DNA, 494 bp, Homo sapiens; identical to SEQ ID NO: 534992
  misc_feature: HIJSMM301DYRDB.9.1.A01.1.454.light.4.raw

SEQ ID NO: 602876 - DNA, 513 bp, Homo sapiens
  misc_feature: HIJSMM301DBG3W.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggaggaccaagctgaccgtcctaagtcagccaaggctgccccctcggtcactctgttcccaccctcctcg

SEQ ID NO: 602877 - DNA, 499 bp, Homo sapiens
  misc_feature: HIJSMM301BM75K.43.25.C03.1.454.light.4.raw
tgtgagtagtcacgaccggtgctcgatttagtagtgtagatttgggtttgggggatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatgacctgcaagtccagtcaaagcctcgttcacagtgatggaaacacctacttgatttggtttcagcagaggccaggccaatctccaaggcgcctaatttataaggtgtctgaccgcgactctggggtcccaggacagattcagcggcagtgggtcagggcactgatttcacactgaagatcagcagggtggaggctgaggatgttggggtttattactgcatgcaaggtacacactggcccgtcaccttcggccaagggacacgactggagattaaacgaactagtggctgcacc

SEQ ID NO: 602878 - DNA, 486 bp, Homo sapiens; identical to SEQ ID NO: 535385
  misc_feature: HIJSMM301EKYWS.19.71.G05.1.454.light.4.raw

SEQ ID NO: 602879 - DNA, 465 bp, Homo sapiens; identical to SEQ ID NO: 538589
  misc_feature: HIJSMM301A803Q.12.39.D06.1.454.light.4.raw

SEQ ID NO: 602880 - DNA, 506 bp, Homo sapiens; identical to SEQ ID NO: 551450
  misc_feature: HIJSMM301BSZG6.5.24.C02.1.454.light.4.raw

SEQ ID NO: 602881 - DNA, 490 bp, Homo sapiens; identical to SEQ ID NO: 537951
  misc_feature: HIJSMM301C74KD.19.57.F02.1.454.light.4.raw

SEQ ID NO: 602882 - DNA, 511 bp, Homo sapiens
  misc_feature: HIJSMM301AD5G1.48.86.H09.1.454.light.4.raw
agtatacatacacgaccggtgctcgatttagtgctatagacttgggtttgggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgttccccg

SEQ ID NO: 602883 - DNA, 498 bp, Homo sapiens
  misc_feature: HIJSMM301BXK6Z.40.73.G07.1.454.light.4.raw
tctagcgactcacgaccggtgctcgatttagctctacgctcagggggagagctgctcagttaggacccagagggaaccatggaaaccccagcgcaacttctcttcctcctgctactctggctcccagaaaccaccggagaaatagtgttgaagcagtctccagacaccctgtctttgtctccaggggagagagccaccctctcctgcagggccagtcagagtgttagcagcaactccattgcctggtaccagcagaaacctggccagtctcccaggctcctcatctatggtgcttcgaccaggctcaccggcatccctgacaggttcactgccagtgggtctgggacagacttcactctcatcatcaccagactagaacctgaggattttgcagtgtattttgtcaacaacatgataagtcaccgttcagctttggccgggggacccaggtggagatcagacgaactgtggctgcaccatctgtcttcatcttccccg

SEQ ID NO: 602884 - DNA, 507 bp, Homo sapiens
  misc_feature: HIJSMM301AHVS0.18.37.D04.1.454.light.4.raw
  modified_base (498)..(498): a, c, t, g, unknown or other
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccgaaggtggagatacaacgaactgtggctgcnccatctgtt

SEQ ID NO: 602885 - DNA, 498 bp, Homo sapiens
  misc_feature: HIJSMM301CSBRU.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggtattttgcagtgtattactgtcagcagtatcataggtacaaacaccttcggccaagggacacgactggagattaaaggaactagtggctgcaccatctgtcttcattcttccccg

SEQ ID NO: 602886 - DNA, 489 bp, Homo sapiens; identical to SEQ ID NO: 535091
  misc_feature: HIJSMM301A8KX9.47.36.D03.1.454.light.4.raw

SEQ ID NO: 602887 - DNA, 508 bp, Homo sapiens
  misc_feature: HIJSMM301E0ITL.11.75.G09.1.454.light.4.raw
cgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagccccaaggctgccccctcggtcactctgttcccta

SEQ ID NO: 602888 - DNA, 513 bp, Homo sapiens; identical to SEQ ID NO: 582828
  misc_feature: HIJSMM301C2PC2.15.34.D01.1.454.light.4.raw

SEQ ID NO: 602889 - DNA, 488 bp, Homo sapiens
  misc_feature: HIJSMM301CWKAU.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcaggctggagtctgaagattttgcagtgtattattgtcagcaatatggtagtcactgggactttggcagggacaagctggagatcaacgaactgtggctgcaccatctgtctt

SEQ ID NO: 602890 - DNA, 504 bp, Homo sapiens; identical to SEQ ID NO: 558529
  misc_feature: HIJSMM301BSNDS.41.35.D02.1.454.light.4.raw

SEQ ID NO: 602891 - DNA, 506 bp, Homo sapiens; identical to SEQ ID NO: 534969
  misc_feature: HIJSMM301CVAU0.18.37.D04.1.454.light.4.raw

SEQ ID NO: 602892 - DNA, 479 bp, Homo sapiens; identical to SEQ ID NO: 551220
  misc_feature: HIJSMM301AI7Q9.52.1.A01.1.454.light.4.raw

SEQ ID NO: 602893 - DNA, 507 bp, Homo sapiens; identical to SEQ ID NO: 539817
  misc_feature: HIJSMM301DBOH9.5.24.C02.1.454.light.4.raw

SEQ ID NO: 602894 - DNA, 501 bp, Homo sapiens; identical to SEQ ID NO: 538461
  misc_feature: HIJSMM301BQ1LW.13.11.A11.1.454.light.4.raw

SEQ ID NO: 602895 - DNA, 497 bp, Homo sapiens
  misc_feature: HIJSMM301DV4VJ.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcaggtgggtctgggaacagagttcactctcaccatcagcggcctgcagtctgaagattttgctagtttattactgtcagcagtataatgacttgggttttattctactttcggccctgggaccaaagtggatttcagacgaactgtggctgcaccatctgtcttcta

SEQ ID NO: 602896 - DNA, 509 bp, Homo sapiens
  misc_feature: HIJSMM301AE0QF.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttctaccatcagcagcctgcagcctcgaagatattgcaacatattactgtcaacagtatcataatactccccaccttcgtccgtccggacgaaacgtaggtagtatactaaaccgaaactacgtggcgtcgtcgacccactactcgttc

SEQ ID NO: 602897 - DNA, 485 bp, Homo sapiens; identical to SEQ ID NO: 535606
  misc_feature: HIJSMM301A23XV.47.46.E02.1.454.light.4.raw

SEQ ID NO: 602898 - DNA, 484 bp, Homo sapiens
  misc_feature: HIJSMM301D43BR.14.53.E09.1.454.light.4.raw
cgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggagggaccaagctgaccgtcctaggtcagcccaaggctcgccccctcggtca

SEQ ID NO: 602899 - DNA, 488 bp, Homo sapiens
  misc_feature: HIJSMM301DEM97.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggtccaagggaccaaggtaggatatcagacgaa

SEQ ID NO: 602900 - DNA, 487 bp, Homo sapiens; identical to SEQ ID NO: 540408
  misc_feature: HIJSMM301EC4W7.41.33.C11.1.454.light.4.raw

SEQ ID NO: 602901 - DNA, 485 bp, Homo sapiens
  misc_feature: HIJSMM301DE06X.10.4.A04.1.454.light.4.raw
catagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagccaccattacatgctctggagaagcgttgagcgataaatttgtttcgtggtataaacagaagtcaggccagtcgcctgtgttggtcatctatcaaaatattaagcggccctcaggggtccctgagcgaatctctggcgccaagtctgggaccacaggcacgctgaccatcagtgtgacccaggctgtggatgaggcagactattactgtcaggcgtgggacagtagcgctgtgtattttcggcggagggaccaagctcgaccgtcctaggtcacgcccaaggcctgccccctc

SEQ ID NO: 602902 - DNA, 486 bp, Homo sapiens; identical to SEQ ID NO: 535917
  misc_feature: HIJSMM301BFNA8.3.10.A10.1.454.light.4.raw

SEQ ID NO: 602903 - DNA, 505 bp, Homo sapiens; identical to SEQ ID NO: 535503
  misc_feature: HIJSMM301C17VM.8.28.C06.1.454.light.4.raw

SEQ ID NO: 602904 - DNA, 498 bp, Homo sapiens; identical to SEQ ID NO: 535295
  misc_feature: HIJSMM301AJB6W.15.25.C03.1.454.light.4.raw

SEQ ID NO: 602905 - DNA, 485 bp, Homo sapiens; identical to SEQ ID NO: 542735
  misc_feature: HIJSMM301C5EHO.26.45.E01.1.454.light.4.raw

SEQ ID NO: 602906 - DNA, 486 bp, Homo sapiens; identical to SEQ ID NO: 535043
  misc_feature: HIJSMM301CGJ9Q.46.35.D02.1.454.light.4.raw

SEQ ID NO: 602907 - DNA, 511 bp, Homo sapiens
  misc_feature: HIJSMM301BPHFR.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcgccaaggaccgaacggtaggaagtacaacgaactagtggctgcaccatctgtcttctactcttcccgtccact

SEQ ID NO: 602908 - DNA, 485 bp, Homo sapiens; identical to SEQ ID NO: 536799
  misc_feature: HIJSMM301D4BLB.19.71.G05.1.454.light.4.raw

SEQ ID NO: 602909 - DNA, 510 bp, Homo sapiens; identical to SEQ ID NO: 553863
  misc_feature: HIJSMM301DZR2V.16.46.E02.1.454.light.4.raw

SEQ ID NO: 602910 - DNA, 514 bp, Homo sapiens
  misc_feature: HIJSMM301CXTBO.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcgggcggagggaccaagctgaccgtcctaagtcagcccaaggctgcccctcggtcactctgttcccgcctcctcg

SEQ ID NO: 602911 - DNA, 495 bp, Homo sapiens; identical to SEQ ID NO: 550605
  misc_feature: HIJSMM301DZDQA.41.38.D05.1.454.light.4.raw

SEQ ID NO: 602912 - DNA, 492 bp, Homo sapiens; identical to SEQ ID NO: 536087
  misc_feature: HIJSMM301ETU5S.10.17.B06.1.454.light.4.raw

SEQ ID NO: 602913 - DNA, 493 bp, Homo sapiens
  misc_feature: HIJSMM301AZ8HX.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggttggagggaccaaaggtggaggtcaaacgaactgtggctgcaccatctgtcttcatt

SEQ ID NO: 602914 - DNA, 485 bp, Homo sapiens
  misc_feature: HIJSMM301DLS9O.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtctaggtcagcccaaggccaa

SEQ ID NO: 602915 - DNA, 471 bp, Homo sapiens; identical to SEQ ID NO: 555745
  misc_feature: HIJSMM301EIDU6.18.76.G10.1.454.light.4.raw

SEQ ID NO: 602916 - DNA, 496 bp, Homo sapiens
  misc_feature: HIJSMM301EQXSP.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcaagagtactacttttacctcaagtgatcaccttcggccaagggacacgactggagattaaacgaactgtggctgcaccatctgtctt

SEQ ID NO: 602917 - DNA, 490 bp, Homo sapiens; identical to SEQ ID NO: 535936
  misc_feature: HIJSMM301CDQC0.16.68.G02.1.454.light.4.raw

SEQ ID NO: 602918 - DNA, 502 bp, Homo sapiens
  misc_feature: HIJSMM301ECFWP.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccgaagctgaccgtcctaggtcagcccaaggctcg

SEQ ID NO: 602919 - DNA, 508 bp, Homo sapiens; identical to SEQ ID NO: 541821
  misc_feature: HIJSMM301C67JS.5.60.F05.1.454.light.4.raw

SEQ ID NO: 602920 - DNA, 496 bp, Homo sapiens
  misc_feature: HIJSMM301E1RMR.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactgacatcccagacaggttcagtggcagtgggtctggggacaggacttcactctcaccatcagcagactggagcctgaggattttgcagtgtattactgtcagcagtatcataggtcaaacaccttcggccaagggacacgactggagattaaaggaactgtggctgcaccatctgtcttcatcttccccg

SEQ ID NO: 602921 - DNA, 504 bp, Homo sapiens
  misc_feature: HIJSMM301EGQD9.47.55.E11.1.454.light.4.raw
agctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctagggcacgtgagactcaggaaatgaccagaggggagtgaatgaggggtgcagagaactccatggctaccaggtcagcccaaggccaaccccactgtcactctcgttcccaccctcctcta

SEQ ID NO: 602922 - DNA, 489 bp, Homo sapiens; identical to SEQ ID NO: 535139
  misc_feature: HIJSMM301EBFAV.14.55.E11.1.454.light.4.raw

SEQ ID NO: 602923 - DNA, 498 bp, Homo sapiens; identical to SEQ ID NO: 592075
  misc_feature: HIJSMM301EMU39.43.34.D01.1.454.light.4.raw

SEQ ID NO: 602924 - DNA, 497 bp, Homo sapiens
  misc_feature: HIJSMM301EWN40.18.26.C04.1.454.light.4.raw
tacgagtatgcacgaccggtgctcgatttagtctagcgactttgggtttggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccaaggtagagatcaaaggaactgtggctgcaccatctgtcttcatcttctcg

SEQ ID NO: 602925 - DNA, 497 bp, Homo sapiens
  misc_feature: HIJSMM301DOI9M.43.42.D09.1.454.light.4.raw
tgtgagtagtcacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtgagacagttactgttaattatttggcctggtaccagcagaagcctggccaggctcccaggctcctcatctctgctgcatcctacagggccactggcatcccagacaggttcagtggcaggtgggtctgggacagacttcactctctccatcagcagactggagcctgaagattttgcaatttattactgtcaccagtatggtagctcacctctaactttcggcggagggaccaaggtggagatcaaacgaactgtggctgcaccatctgtcttcta

SEQ ID NO: 602926 - DNA, 497 bp, Homo sapiens; identical to SEQ ID NO: 577847
  misc_feature: HIJSMM301D2IPH.3.33.C11.1.454.light.4.raw

SEQ ID NO: 602927 - DNA, 517 bp, Homo sapiens
  misc_feature: HIJSMM301BI52N.49.58.F03.1.454.light.4.raw
agtcgagagacacgaccggtgctcgatttagtctgatcgagaagggaaaggggagagaagacaggattcaggacaatctccagcatggccggcttccctctcctcctcaccctcctcactcactgcgcagggtcctgggcccagtctgtgttgactcagccgccctcagcgtctgggacccccgggcagagggtcatcatctcttgttctggaagcagctccaacatcggaagtaactttgcttactggtaccaacaactcccaggaacggcccccaaattcctcttgtataggagtaatcagcggccctcaggggtccctgaccgattctctggctcccagtctggcacctcagcctccctggccatcagtggcctccggtccgaggatgaggctgattattattgtgcagcatgggatgacagcctgagtggtctcgtcttcggagctgggaccaaggtcaccgtcctaggtcagcccaaggccaaccccactgtcactctgttcccgccctcct

SEQ ID NO: 602928 - DNA, 508 bp, Homo sapiens
  misc_feature: HIJSMM301C70UV.17.28.C06.1.454.light.4.raw
cgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtctaagtcagcccaaggctgcccccc

SEQ ID NO: 602929 - DNA, 494 bp, Homo sapiens; identical to SEQ ID NO: 535276
  misc_feature: HIJSMM301CL9AN.16.6.A06.1.454.light.4.raw

SEQ ID NO: 602930 - DNA, 487 bp, Homo sapiens
  misc_feature: HIJSMM301DFCC8.14.55.E11.1.454.light.4.raw
  modified_base (427)..(427): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctnactttcggcgagggaccaaggcggagatcagacgaactgtggctgcaccatctgtcttca

SEQ ID NO: 602931 - DNA, 495 bp, Homo sapiens; identical to SEQ ID NO: 536316
  misc_feature: HIJSMM301B9GHB.40.23.C01.1.454.light.4.raw

SEQ ID NO: 602932 - DNA, 502 bp, Homo sapiens; identical to SEQ ID NO: 537816
  misc_feature: HIJSMM301DG3NE.19.78.H01.1.454.light.4.raw

SEQ ID NO: 602933 - DNA, 490 bp, Homo sapiens
  misc_feature: HIJSMM301CU3QV.11.12.B01.1.454.light.4.raw
cgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaataccaggcggccctctggggtccctgagcgattctccggctccggctctgggaacacagtcactctgaccatcagcgggacccaggctattgatgaggctgtctacttctgtcaggcgtgggacaacagcgtggtgttcggcggagggaccagtctgaccgtcttaggtcagcccaaggctgccccctcggtcactcc

SEQ ID NO: 602934 - DNA, 495 bp, Homo sapiens
  misc_feature: HIJSMM301BVG50.48.36.D03.1.454.light.4.raw
agtatacatacacgaccggtgctcgatttagctgcgtcacgatctctcttggggaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttcaagttcctttttgtcttcggaactc

SEQ ID NO: 602935 - DNA, 487 bp, Homo sapiens
  misc_feature: HIJSMM301DSPWQ.14.53.E09.1.454.light.4.raw
cgtctagtaccacgaccggtgctcgatttagagagagtgtgttgggtttgggggggagcctagctgtgctgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgtctttttggtaccagcagaagccaggccaggcccctctcttgattatatataaggacactgagaggccctcagggatccctgagcgattctctggctccagctcgagggacaacactcaccttgaccatcagtgcagtccaggcagaagacgaggctgactattattgtcaatcagcagtcagcactaattcttatcgggtgttcggcggaggaccaagctgaccgtccta

SEQ ID NO: 602936 - DNA, 520 bp, Homo sapiens
  misc_feature: HIJSMM301BJC8F.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcgggacccagaccctggagcctcagttggaagcagccgatccagcctgcggagccgtgtggggcaggtcagcccaaggctcgccccctcggtcactctcgttcccaccctcctccacg

SEQ ID NO: 602937 - DNA, 494 bp, Homo sapiens; identical to SEQ ID NO: 598606
  misc_feature: HIJSMM301D3M8F.27.78.H01.1.454.light.4.raw

SEQ ID NO: 602938 - DNA, 487 bp, Homo sapiens; identical to SEQ ID NO: 541729
  misc_feature: HIJSMM301CYNZE.40.83.H06.1.454.light.4.raw

SEQ ID NO: 602939 - DNA, 444 bp, Homo sapiens
  misc_feature: HIJSMM301BG1O8.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccatcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcggcggagggaaccaagctgaccgtcctaggtcagcccaaggctgccccctcggcactctgttcccaccctcctcagacgtatca

SEQ ID NO: 602940 - DNA, 453 bp, Homo sapiens
  misc_feature: HIJSMM301AE3VX.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactt

SEQ ID NO: 602941 - DNA, 493 bp, Homo sapiens
  misc_feature: HIJSMM301BHNBO.22.86.H09.1.454.light.4.raw
acatacgcgtcacgaccggtgctcgatttagtgctatagacttggggtttggggggggtcgtcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcagggcgcctactacttgggtgttcggcggagggaccaagctgaccgtcctaggtcagcccaa

SEQ ID NO: 602942 - DNA, 506 bp, Homo sapiens
  misc_feature: HIJSMM301D90SI.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactggggctcaggcggaagatgaggctgactattactgtaactcccgggacagcagtgctgaccaggtggtattcgggcggagggacccacctgaccgtcttaggtcagcccaaggctcgccccctcggtctacc

SEQ ID NO: 602943 - DNA, 487 bp, Homo sapiens
  misc_feature: HIJSMM301BPG74.43.4.A04.1.454.light.4.raw
  modified_base (196)..(196): a, c, t, g, unknown or other
tgtgagtagtcacgaccggtgctcgatttagagtagtgatcagggggaagagctgctcagttaggacccagagggaaccatggaaaccccagcgcagcttctcttcctcctgctactctggctcccagtctcagatatcaccggagaaattgtgttggcgcagtctcctggcaccctgtctttgtctccagggganagagccacgctctcttgcagggccagtcagagtatcagtagcaactacttaacctggtaccagcagaaatctggccaggctcccaggctcctcatctacagtgcgtccaggaggcctctggcatcccagacaggttcagtggcagtgggtctgggacagacttcactctcaccatctccagactggagcctgaacgattttagcagtgtattactgtcagcaatttatacttcagtctggacgttcggccaagggaccaaggtggacatcaaacgaactgtaggctgcacc

SEQ ID NO: 602944 - DNA, 514 bp, Homo sapiens
  misc_feature: HIJSMM301DTN3M.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctggtcactctcgttcccaccctcct

SEQ ID NO: 602945 - DNA, 505 bp, Homo sapiens; identical to SEQ ID NO: 535503
  misc_feature: HIJSMM301AL2BZ.8.28.C06.1.454.light.4.raw

SEQ ID NO: 602946 - DNA, 507 bp, Homo sapiens; identical to SEQ ID NO: 567373
  misc_feature: HIJSMM301EJ2HS.47.83.H06.1.454.light.4.raw

SEQ ID NO: 602947 - DNA, 489 bp, Homo sapiens; identical to SEQ ID NO: 536013
  misc_feature: HIJSMM301CE7Z2.26.23.C01.1.454.light.4.raw

SEQ ID NO: 602948 - DNA, 516 bp, Homo sapiens
  misc_feature: HIJSMM301C178S.5.27.C05.1.454.light.4.raw
  modified_base (511)..(511): a, c, t, g, unknown or other
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaacgtgggaccaaggtcacccgtctaggtcagccaaggccaacccactgtcactctgttcccgcctccncgtgt

SEQ ID NO: 602949 - DNA, 521 bp, Homo sapiens; identical to SEQ ID NO: 539470
  misc_feature: HIJSMM301CP4EO.27.23.C01.1.454.light.4.raw

SEQ ID NO: 602950 - DNA, 444 bp, Homo sapiens; identical to SEQ ID NO: 535856
  misc_feature: HIJSMM301AT54I.9.9.A09.1.454.light.4.raw

SEQ ID NO: 602951 - DNA, 503 bp, Homo sapiens; identical to SEQ ID NO: 591990
  misc_feature: HIJSMM301AHJWY.18.26.C04.1.454.light.4.raw

SEQ ID NO: 602952 - DNA, 493 bp, Homo sapiens; identical to SEQ ID NO: 540880
  misc_feature: HIJSMM301D7QV0.40.81.H04.1.454.light.4.raw

SEQ ID NO: 602953 - DNA, 507 bp, Homo sapiens
  misc_feature: HIJSMM301DAX28.4.57.F02.1.454.light.4.raw
  modified_base (492)..(492): a, c, t, g, unknown or other
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggacaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactggaccaaggtctccgtcctacgtcagcccaaggccaacccacngtcactctgttccca

SEQ ID NO: 602954 - DNA, 478 bp, Homo sapiens
  misc_feature: HIJSMM301C6UMN.48.27.C05.1.454.light.4.raw
agtatacatacacgaccggtgctcgatttagacgcgatcgaagggtttggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagcccaa

SEQ ID NO: 602955 - DNA, 488 bp, Homo sapiens
  misc_feature: HIJSMM301CLX4Y.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagttgcagtggatctgggacagatttcactctcaccatcagcagtctgcaacctgaagattttgcaacttactactgtcaacagagttacggtaccccgtacacttttggccaggggaccaaactggacatcaaacgaactgtggctgcaccatctgtt

SEQ ID NO: 602956 - DNA, 484 bp, Homo sapiens; identical to SEQ ID NO: 536162
  misc_feature: HIJSMM301DDRIL.13.59.F04.1.454.light.4.raw

SEQ ID NO: 602957 - DNA, 521 bp, Homo sapiens; identical to SEQ ID NO: 538715
  misc_feature: HIJSMM301ESFTW.27.23.C01.1.454.light.4.raw

SEQ ID NO: 602958 - DNA, 505 bp, Homo sapiens
  misc_feature: HIJSMM301AFPSY.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttccggccaagggacacgactaggagaattaaacgtaaacctagtggcgtgcgacccatctgtcttt

SEQ ID NO: 602959 - DNA, 501 bp, Homo sapiens; identical to SEQ ID NO: 536142
  misc_feature: HIJSMM301D8CIZ.15.1.A01.1.454.light.4.raw

SEQ ID NO: 602960 - DNA, 503 bp, Homo sapiens; identical to SEQ ID NO: 535044
  misc_feature: HIJSMM301A0K9D.19.78.H01.1.454.light.4.raw

SEQ ID NO: 602961 - DNA, 495 bp, Homo sapiens
  misc_feature: HIJSMM301CNYY3.9.12.B01.1.454.light.4.raw
  modified_base (488)..(488): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgtgtcagacgacgacggaagataacgaacagtacgagtgctacgacactgtctntctactt

SEQ ID NO: 602962 - DNA, 503 bp, Homo sapiens; identical to SEQ ID NO: 543363
  misc_feature: HIJSMM301A2AVU.19.78.H01.1.454.light.4.raw

SEQ ID NO: 602963 - DNA, 479 bp, Homo sapiens
  misc_feature: HIJSMM301DIE4T.48.24.C02.1.454.light.4.raw
agtatacatacacgaccggtgctcgatttagtacagatcgttagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttatcactatgtctcctggtaccaacagcaccctggcaaagcccccaaactcatgatttatgatatcactaagcggccctcaggggtccctgatcgcttctctggctcccagtctggcaacacggcctccctgaccatctctgggctccaggctgaggatgaggctgattattactgctgctcatatgcaggcagctacactttggtgttcggcggagggaccaagctgactgtcc

SEQ ID NO: 602964 - DNA, 495 bp, Homo sapiens; identical to SEQ ID NO: 535596
  misc_feature: HIJSMM301EMENR.10.79.H02.1.454.light.4.raw

SEQ ID NO: 602965 - DNA, 444 bp, Homo sapiens; identical to SEQ ID NO: 534993
  misc_feature: HIJSMM301A2RSA.5.9.A09.1.454.light.4.raw

SEQ ID NO: 602966 - DNA, 480 bp, Homo sapiens
  misc_feature: HIJSMM301BMWMI.11.11.A11.1.454.light.4.raw
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcaccccgggagtccctgaccgattcagtggcagcgggtctgggacagacttcactctcaccatcagcaacctgcaggctgaagatgtggcagtttattactgtcagcagtattgtgaagctccgctcactttcggcggagggaccgcggtggagatcagacgaactgtggctgcaccatctgtctt

SEQ ID NO: 602967 - DNA, 511 bp, Homo sapiens
  misc_feature: HIJSMM301A8UM3.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaactgaccgtcctaggtcacgccaaggctcgccccctcggtcactctgttccccg

SEQ ID NO: 602968 - DNA, 483 bp, Homo sapiens; identical to SEQ ID NO: 575196
  misc_feature: HIJSMM301ENPT6.41.34.D01.1.454.light.4.raw

SEQ ID NO: 602969 - DNA, 496 bp, Homo sapiens
  misc_feature: HIJSMM301BB7IK.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccaggggaccgaagctggagatcaaacgaactgtggctgcaccatctgtctt

SEQ ID NO: 602970 - DNA, 473 bp, Homo sapiens
  misc_feature: HIJSMM301COU5Z.13.76.G10.1.454.light.4.raw
tcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaagtcacg

SEQ ID NO: 602971 - DNA, 496 bp, Homo sapiens
  misc_feature: HIJSMM301DF5PQ.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctacagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcacttattactgtcagcagcgtagcaactggcctctcactttcggcggagggaccgagggtggaggatcagacgaactgtggctgcaa

SEQ ID NO: 602972 - DNA, 505 bp, Homo sapiens
  misc_feature: HIJSMM301D160V.47.85.H08.1.454.light.4.raw
agctcacgtacacgaccggtgctcgatttagtatcactcagtcgcgggggctggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttggcaactactgtcgtttggtgttcggcggagggaccaagttgaccgtcctaggtcagcccaaggctgccccctcggtcact

SEQ ID NO: 602973 - DNA, 509 bp, Homo sapiens
  misc_feature: HIJSMM301BCWXZ.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggtccgaagggacccgaaaggtggaaagtcaaaacgaactagtggctgcaccatt

SEQ ID NO: 602974 - DNA, 491 bp, Homo sapiens
  misc_feature: HIJSMM301A1OFG.26.70.G04.1.454.light.4.raw
  modified_base (427)..(427): a, c, t, g, unknown or other
agactatactcacgaccggtgctcgatttagtgtagtgtgaagggaaagggggcaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgtcgggcgagtcagggcattagcgattttttagccttggtttcagcagaaaccagggaaacgcccccaagtccctgatctatgctgcgtccactttagaaggtggagtcccatcaaggttcagcggcagtggatctgggacagagttcactctcaacatcagcagcctgcagcctgaggattttgctaacttattactgccagcagtataatnattaccctatcaccttcggccgggggacacggctaggaaactaaacgaactggtggctgcaccc

SEQ ID NO: 602975 - DNA, 502 bp, Homo sapiens
  misc_feature: HIJSMM301DM45F.12.67.G01.1.454.light.4.raw
  modified_base (445)..(445): a, c, t, g, unknown or other
atacgacgtacacgaccggtgctcgatttagagtatacatattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcagagcccccaaactcatgatttttgatgtcactaatcggccctcaggggtttctgatcgcttctctggctccaagtctgactacacggcctccctgaccatctctgggctccaggctgaggacgaggctgattattattgcagctcatatacaagcagcagcaccctntttgtcttcggaagtgggaccaaggtcaccgtcctacgtcagcccaaggccaaccca

SEQ ID NO: 602976 - DNA, 504 bp, Homo sapiens
  misc_feature: HIJSMM301BXLIG.40.71.G05.1.454.light.4.raw
tctagcgactcacgaccggtgctcgatttagtgtcgtcgcaagagagaggggggctctgcttcagctgtgagcgcagaaggcaggactcgggacaatcttcatcatgacctgctcccctctcctcctcacccttctcattcactacacagggtcctgggcccagtctgtgttgacgcagccgccctcagtgtctgcggccccgggacagaaggtcaccatctcctgctctggaagcagctccaacattgggaaaaattatgtatcctggtaccagcagctcccaggaacagcccccaaactcctcatttatgacaataataagcgaccctcagggattcctgaccgattctctggctccaagtctggcacgtcagccaccctgggcatcaccggactccagactggcgacgaggccgtttattattgcggaacatgggatagcggcctgagtgatgagtggatgttcggcggcgggaccaaactgaccgtcctaggtcagcccg

SEQ ID NO: 602977 - DNA, 515 bp, Homo sapiens
  misc_feature: HIJSMM301BXTYC.8.87.H10.1.454.light.4.raw
  modified_base (487)..(487): a, c, t, g, unknown or other
ctcgcgtgtccacgaccggtgctcgatttagcagtactgcgttgggtttggggctgggcctcaggaagcagcattgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtaccagcagaagccaggccaggcccctgtactggtcatctttagcgattccaaccggccctctgggatccctgagcgattctctggctccaagtcggggaacacggccaccctgaccatcagcagggcccaacccttggatgaggtgactattctgtcaagtgtgggacaccaacacttgtgtcttcgggactgggaccgaggtcaccgtcctaagtcagcccagggccaaccccacngtcactctgttcccacctcctcgacacg

SEQ ID NO: 602978 - DNA, 500 bp, Homo sapiens
  misc_feature: HIJSMM301C8IPU.40.53.E09.1.454.light.4.raw
tctagcgactcacgaccggtgctcgatttagagagagtgtgttgggtttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggtcagagggtcaccatctcttgttctggaagcagatccaacatcggaagtaatactgtaaactggtaccagcagctcccaggaacggcccccaaactcctcatctatgataatagtcaccggccctcaggggtacctgaccgattctctggctccaagtctggcacctcagcctccctggccatcagtgggctccagtctgaggatgaggctgattatcactgtgcatcctgggatgacagcctgaatggttgggtgttcggcgggggaccgaagctgaccgtcctaagtcagccaac

SEQ ID NO: 602979 - DNA, 514 bp, Homo sapiens; identical to SEQ ID NO: 560276
  misc_feature: HIJSMM301DVAGF.15.86.H09.1.454.light.4.raw

SEQ ID NO: 602980 - DNA, 494 bp, Homo sapiens; identical to SEQ ID NO: 534994
  misc_feature: HIJSMM301DW7G6.27.78.H01.1.454.light.4.raw

SEQ ID NO: 602981 - DNA, 475 bp, Homo sapiens; identical to SEQ ID NO: 548701
  misc_feature: HIJSMM301EXNF2.3.1.A01.1.454.light.4.raw

SEQ ID NO: 602982 - DNA, 497 bp, Homo sapiens; identical to SEQ ID NO: 539718
  misc_feature: HIJSMM301AU1D2.40.54.E10.1.454.light.4.raw

SEQ ID NO: 602983 - DNA, 530 bp, Homo sapiens
  misc_feature: HIJSMM301DK88E.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaagggtcgccccgtccggtcgtactctcgttccctacccctccctccttaccg

SEQ ID NO: 602984 - DNA, 444 bp, Homo sapiens; identical to SEQ ID NO: 537971
  misc_feature: HIJSMM301AJUXY.2.76.G10.1.454.light.4.raw

SEQ ID NO: 602985 - DNA, 499 bp, Homo sapiens
  misc_feature: HIJSMM301CH4AU.43.33.C11.1.454.light.4.raw
tgtgagtagtcacgaccggtgctcgatttagagtgagctcgttgggtttgggcggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaatttcggtcaggggaccaagttgaacatc

SEQ ID NO: 602986 - DNA, 521 bp, Homo sapiens; identical to SEQ ID NO: 539470
  misc_feature: HIJSMM301DK2YL.27.23.C01.1.454.light.4.raw

SEQ ID NO: 602987 - DNA, 508 bp, Homo sapiens; identical to SEQ ID NO: 552440
  misc_feature: HIJSMM301ETBOA.5.24.C02.1.454.light.4.raw

SEQ ID NO: 602988 - DNA, 499 bp, Homo sapiens
  misc_feature: HIJSMM301CQGPK.15.25.C03.1.454.light.4.raw
tctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactagaaaatcagcagagtggaggctgaggacgttggggtttattactgcatgcaaggtctacaaaccccgatcaccttcggccgagggacacgcctggagattaaacgaactgtggctgcaccat

SEQ ID NO: 602989 - DNA, 498 bp, Homo sapiens
  misc_feature: HIJSMM301BS5IG.15.25.C03.1.454.light.4.raw
tctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatcagcagagtggaggctgaggacgttggggtttattactgcatgcaaggtctacaaaccccgatcaccttcggccgagggacacgcctggagattaaacgaactagtggctgcacc

SEQ ID NO: 602990 - DNA, 489 bp, Homo sapiens; identical to SEQ ID NO: 540424
  misc_feature: HIJSMM301B4KUX.17.25.C03.1.454.light.4.raw

SEQ ID NO: 602991 - DNA, 506 bp, Homo sapiens
  misc_feature: HIJSMM301AVDDL.15.66.F11.1.454.light.4.raw
tctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcaggggtccctgatcgcttctctggctccaagtctggcgactcggcctccctgaccgtctctgggctccagcctgaagatgaggctgattatttctgcggctcatatggagacaattacagctttgtcttcggaagtgggaccaaggtcaccgtcctaagtcagcccaaggcccaaccccactgtcactctgttcccgccct

SEQ ID NO: 602992 - DNA, 485 bp, Homo sapiens; identical to SEQ ID NO: 536799
  misc_feature: HIJSMM301BZ6VY.19.71.G05.1.454.light.4.raw

SEQ ID NO: 602993 - DNA, 519 bp, Homo sapiens
  misc_feature: HIJSMM301DDC58.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtgggacgttcggccaagggaccaaggtggcaatcaaccgaactgtggctgcaccatctgtcttcatcttccccg

SEQ ID NO: 602994 - DNA, 500 bp, Homo sapiens; identical to SEQ ID NO: 551605
  misc_feature: HIJSMM301DGKOS.2.34.D01.1.454.light.4.raw

SEQ ID NO: 602995 - DNA, 497 bp, Homo sapiens
  misc_feature: HIJSMM301DRYH2.12.87.H10.1.454.light.4.raw
atacgacgtacacgaccggtgctcgatttagcagtactgcgttgggtttgggactgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcattgggggaaaagtttgctttctggtatcagcagaagccaggccagtcccctgtcttggtcatctataaggatagcaggcggccctcagggattcctgagcgattctccggctccaactccggcaacacagccactctgaccatcagcgggacccaggctctcgatgaggctgactattactgccaggcgtgggacagctccacttcccgttatgtcttcggaggtgggaccatggtcaccgtcctaggtcagcccaagaccaaccccactgt

SEQ ID NO: 602996 - DNA, 490 bp, Homo sapiens
  misc_feature: HIJSMM301A1GWN.14.55.E11.1.454.light.4.raw
cgtctagtaccacgaccggtgctcgatttagcactcgcacgttgggtttggggagtctcagtcaggacacggcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtggctgcaccatctgtcttcatt

SEQ ID NO: 602997 - DNA, 461 bp, Homo sapiens
  misc_feature: HIJSMM301C97EJ.18.78.H01.1.454.light.4.raw
tacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagccccaaggccaaccccactgtcactctgttcccaccctcctccatactcgta

SEQ ID NO: 602998 - DNA, 502 bp, Homo sapiens; identical to SEQ ID NO: 564997
  misc_feature: HIJSMM301BB1IM.9.71.G05.1.454.light.4.raw

SEQ ID NO: 602999 - DNA, 482 bp, Homo sapiens
  misc_feature: HIJSMM301D29VN.11.76.G10.1.454.light.4.raw
cgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtccctgaccgattccgtggcagtggatctgggacaaatttcactctcaccatcaatagcctgcaggctgaagatgtggcagcttattattgtcagcaatattatacttctcttccgatcacttttggtccaggggaccaggctggagatcagacgaactgt

SEQ ID NO: 603000 - DNA, 502 bp, Homo sapiens; identical to SEQ ID NO: 536253
  misc_feature: HIJSMM301C4UD3.21.22.B11.1.454.light.4.raw

SEQ ID NO: 603001 - DNA, 505 bp, Homo sapiens
  misc_feature: HIJSMM301DFWGQ.13.25.C03.1.454.light.4.raw
tcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatcttgggacttatagacttgtctcctggtaccaacaccacccaggcaaggcccccagagtcatcatttatgggggcaataggcggccgtcagggatttccactcgcttctctggctccaagtctggcaacacggcctccctgacaatctctggtctccaggctgaggacgaggctgcctattactgctgctcatatgcaggttcttctgtggtcttcggcggaggtccaaagtgaccgtcctaggtcagcccaaggctgccccctcggtcactc

SEQ ID NO: 603002 - DNA, 503 bp, Homo sapiens
  misc_feature: HIJSMM301DCGCQ.10.36.D03.1.454.light.4.raw
catagtagtgcacgaccggtgctcgatttagctgcgtcacgatctctcttggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaatgtcgggagagataatgtgtactggtaccagcaggtcccaggaaccggcccccaaactcctcatctataacgattatcggcggccctcaggggtccctgaccgattctctggctccaagtctggcacctcagcctccctggccatcagtgggctccggtccgaggatgacgctgattattactgtgtagcatgggatgacagcctgagtgcttatgtcttcggaactgggaccaaggtcaccgtcctacgtcagcccaaggcccaaccccactgtcta

SEQ ID NO: 603003 - DNA, 476 bp, Homo sapiens
  misc_feature: HIJSMM301BC66F.12.49.E05.1.454.light.4.raw
atacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagcaattttttagcctggtatcagcagaaaccagggaaagttccacacctcctgatctatgctgcatccgctttgcaatcaggggtcccatctcggttcagcggcagtggatctgggacagagttcactctcaccatcagcagcctgcagcctgaagatgttgcaacttattactgtacaaaagtataacagtcgcccccttcaccttcggccaagggacacgactggagattagaacg

SEQ ID NO: 603004 - DNA, 504 bp, Homo sapiens; identical to SEQ ID NO: 581357
  misc_feature: HIJSMM301CNZXT.21.81.H04.1.454.light.4.raw

SEQ ID NO: 603005 - DNA, 506 bp, Homo sapiens
  misc_feature: HIJSMM301C3ZBK.19.78.H01.1.454.light.4.raw
  modified_base (499)..(499): a, c, t, g, unknown or other
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaacccnctgtcta

SEQ ID NO: 603006 - DNA, 444 bp, Homo sapiens
  misc_feature: HIJSMM301BDACT.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctgttccccaccctcctccgttctgat

SEQ ID NO: 603007 - DNA, 496 bp, Homo sapiens
  misc_feature: HIJSMM301DV70Y.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctaacaaactccttactacttttggccaggggaccaaagctggagatacaaacgaaactgt

SEQ ID NO: 603008 - DNA, 481 bp, Homo sapiens
  misc_feature: HIJSMM301EK7QB.40.23.C01.1.454.light.4.raw
tctagcgactcacgaccggtgctcgatttagtacacgtgattagggattgggggggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtctaacgtcagcccaaggcc

SEQ ID NO: 603009 - DNA, 502 bp, Homo sapiens
  misc_feature: HIJSMM301BVVNL.48.86.H09.1.454.light.4.raw
agtatacatacacgaccggtgctcgatttagtgctatagacttgggtttgggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggagggaccaagctgaccgtcctaagtcagcccaaggctcgccccctcggtcta

SEQ ID NO: 603010 - DNA, 484 bp, Homo sapiens; identical to SEQ ID NO: 535240
  misc_feature: HIJSMM301BAN9C.47.60.F05.1.454.light.4.raw

SEQ ID NO: 603011 - DNA, 501 bp, Homo sapiens; identical to SEQ ID NO: 535746
  misc_feature: HIJSMM301BYPG9.18.11.A11.1.454.light.4.raw

SEQ ID NO: 603012 - DNA, 503 bp, Homo sapiens; identical to SEQ ID NO: 537216
  misc_feature: HIJSMM301BPZYJ.3.70.G04.1.454.light.4.raw

SEQ ID NO: 603013 - DNA, 487 bp, Homo sapiens; identical to SEQ ID NO: 537208
  misc_feature: HIJSMM301DULB9.3.55.E11.1.454.light.4.raw

SEQ ID NO: 603014 - DNA, 493 bp, Homo sapiens
  misc_feature: HIJSMM301DMKPM.13.36.D03.1.454.light.4.raw
tcacgtactacacgaccggtgctcgatttagctgcgtcacgatctctcttgggggggtcagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggcctcctcatttatggtgcatcccactagggcccactggtgtcccagtcaggttcagcggcagtgggtctgggacagacttcactctcaccatcagcagcctgcagtctgaagattttgcagtctattactgtcagcagtatagttactggagaaccttcggaccgaagggacacgactaggagattaaaggaact

SEQ ID NO: 603015 - DNA, 480 bp, Homo sapiens; identical to SEQ ID NO: 559070
  misc_feature: HIJSMM301DLXFT.21.25.C03.1.454.light.4.raw

SEQ ID NO: 603016 - DNA, 486 bp, Homo sapiens; identical to SEQ ID NO: 535043
  misc_feature: HIJSMM301CDRQ2.46.35.D02.1.454.light.4.raw

SEQ ID NO: 603017 - DNA, 447 bp, Homo sapiens; identical to SEQ ID NO: 563113
  misc_feature: HIJSMM301BA2Q3.18.9.A09.1.454.light.4.raw

SEQ ID NO: 603018 - DNA, 476 bp, Homo sapiens; identical to SEQ ID NO: 585988
  misc_feature: HIJSMM301B7KIS.52.19.B08.1.454.light.4.raw

SEQ ID NO: 603019 - DNA, 489 bp, Homo sapiens; identical to SEQ ID NO: 535139
  misc_feature: HIJSMM301DWKC8.14.55.E11.1.454.light.4.raw

SEQ ID NO: 603020 - DNA, 504 bp, Homo sapiens
  misc_feature: HIJSMM301EYEVJ.7.71.G05.1.454.light.4.raw
  modified_base (492)..(492): a, c, t, g, unknown or other
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggccgtccggggccacttccggccctcgggaccaagtaggatatcaaacgactagtggntgcaccatctgt

SEQ ID NO: 603021 - DNA, 498 bp, Homo sapiens; identical to SEQ ID NO: 580940
  misc_feature: HIJSMM301AWJE3.40.34.D01.1.454.light.4.raw

SEQ ID NO: 603022 - DNA, 507 bp, Homo sapiens
  misc_feature: HIJSMM301DKZ2F.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaatttttgtgtcctggtaccagcagctcccaggaacagcccccaaactcctcatttttgacaataataagcgaccctcagggattcctgaccgattctctggctccaagtctggcacgtcagccaccctgggcatcaccggactccagactggggacgaggccgattattactgcggaacatgggatagcagcctgagtactgtgataatcggcggagggaccaagctgaccgtcctaggtcagcacaaggctgccccctcggtcactctgtt

SEQ ID NO: 603023 - DNA, 495 bp, Homo sapiens
  misc_feature: HIJSMM301BX88Q.19.71.G05.1.454.light.4.raw
tactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccgaagggaccaaggtggatatcagacgaactgtgg

SEQ ID NO: 603024 - DNA, 512 bp, Homo sapiens; identical to SEQ ID NO: 602810
  misc_feature: HIJSMM301AV31Z.7.34.D01.1.454.light.4.raw

SEQ ID NO: 603025 - DNA, 495 bp, Homo sapiens; identical to SEQ ID NO: 576393
  misc_feature: HIJSMM301BUCFL.11.81.H04.1.454.light.4.raw

SEQ ID NO: 603026 - DNA, 494 bp, Homo sapiens; identical to SEQ ID NO: 534992
  misc_feature: HIJSMM301BUZPI.9.1.A01.1.454.light.4.raw

SEQ ID NO: 603027 - DNA, 508 bp, Homo sapiens
  misc_feature: HIJSMM301BUD8M.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgtcgtcgacgggacgacagtacgaatagagacgaacgtagtggcgtgcgaccactctgtcttctatcttcccgt

SEQ ID NO: 603028 - DNA, 491 bp, Homo sapiens
  misc_feature: HIJSMM301APIG7.52.27.C05.1.454.light.4.raw
cgcagtacgacacgaccggtgctcgatttagacgcgatcgaagggtttgggggtcagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacgtgccgggcaagtcagagcattggcaggtatttaaattggtatcaacagaaaccagggaaagcccctaggctcctgatctatgctgcatcccgtttgcaaagtggggtcccgtcaaggttcagtggccgtggatctgggacagatttcactctcaccatcagcagtctccaacctgaagattttgcaatttactactgtcaacagagtgacaatacccctcagactttcggccctgggaccagagtggatatcaaacgaactgtggctgcaccatctgtcttcta

SEQ ID NO: 603029 - DNA, 494 bp, Homo sapiens
  misc_feature: HIJSMM301BDLFA.15.59.F04.1.454.light.4.raw
tctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaagctgccctcaccatcacgggggcccaggcagatgatgaatctgtttattattgtgtcctatatatgggtgctggcatttcggtcttcggcggagggaccaagctgaccgtcctaggtcagcccaaggctgccccctcggtcactctgttccccaccctcctcgctacgtaga

SEQ ID NO: 603030 - DNA, 448 bp, Homo sapiens; identical to SEQ ID NO: 544682
  misc_feature: HIJSMM301DCWGX.18.9.A09.1.454.light.4.raw

SEQ ID NO: 603031 - DNA, 503 bp, Homo sapiens
  misc_feature: HIJSMM301B9NT8.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgattgcttctctgcctccaaggctggcaacacggcctccctgaccgtctctgggctccaggctgaggatgaggctgattattattgcagctcatatgcaggcagttacaatgtgatattcggcggagggaccaaactgaccgtcctaggtcagcccaaggctgccccctcc

SEQ ID NO: 603032 - DNA, 493 bp, Homo sapiens
  misc_feature: HIJSMM301DMFFV.11.12.B01.1.454.light.4.raw
cgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaaataccaggcggccctctggggtccctgagcgattctccggctccggctctgggaacacagtcactctgaccatcagcgggacccaggctattgatgaggctgtctacttctgtcaggcgtgggacaacagcgtggtgttcggcggagggaccagtctgaccgtcgttaggtcagcccaaggctgccccctcggtcactccg

SEQ ID NO: 603033 - DNA, 444 bp, Homo sapiens; identical to SEQ ID NO: 535192
  misc_feature: HIJSMM301A9YY5.5.9.A09.1.454.light.4.raw

SEQ ID NO: 603034 - DNA, 490 bp, Homo sapiens
  misc_feature: HIJSMM301CE92A.3.10.A10.1.454.light.4.raw
  modified_base (435)..(435): a, c, t, g, unknown or other
  modified_base (475)..(475): a, c, t, g, unknown or other
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagcaataacttatctttattntcttcgtagtctggccgacggtcgacgtcctacgtcgtanccaacgacgacccaa

SEQ ID NO: 603035 - DNA, 505 bp, Homo sapiens
  misc_feature: HIJSMM301AE6OS.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggcccaacccca

SEQ ID NO: 603036 - DNA, 521 bp, Homo sapiens; identical to SEQ ID NO: 539470
  misc_feature: HIJSMM301A826O.27.23.C01.1.454.light.4.raw

SEQ ID NO: 603037 - DNA, 493 bp, Homo sapiens; identical to SEQ ID NO: 535084
  misc_feature: HIJSMM301CND9B.47.64.F09.1.454.light.4.raw

SEQ ID NO: 603038 - DNA, 447 bp, Homo sapiens; identical to SEQ ID NO: 535020
  misc_feature: HIJSMM301BRB7Q.18.9.A09.1.454.light.4.raw

SEQ ID NO: 603039 - DNA, 509 bp, Homo sapiens
  misc_feature: HIJSMM301A7Q21.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggccgaagggaccgaaggtggaaatacaaacgaactagtggctgcaccatctgtcttctactcttccccg

SEQ ID NO: 603040 - DNA, 503 bp, Homo sapiens; identical to SEQ ID NO: 551458
  misc_feature: HIJSMM301EGCNA.19.78.H01.1.454.light.4.raw

SEQ ID NO: 603041 - DNA, 486 bp, Homo sapiens; identical to SEQ ID NO: 535523
  misc_feature: HIJSMM301B4OAG.22.73.G07.1.454.light.4.raw

SEQ ID NO: 603042 - DNA, 523 bp, Homo sapiens
  misc_feature: HIJSMM301BWPQ1.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgccgtacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggctagtttattactgtcaactagttttctccgggtcgttcggccgaacgggaaccgaaggtaggaaagttacgaaaacgaactaggtggcgtgcaccactctcgttcttcatcttccccg

SEQ ID NO: 603043 - DNA, 483 bp, Homo sapiens
  misc_feature: HIJSMM301DQ0PA.15.1.A01.1.454.light.4.raw
  modified_base (482)..(482): a, c, t, g, unknown or other
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttccccctctccgctacgtana

SEQ ID NO: 603044 - DNA, 483 bp, Homo sapiens; identical to SEQ ID NO: 545669
  misc_feature: HIJSMM301CSDBA.13.8.A08.1.454.light.4.raw

SEQ ID NO: 603045 - DNA, 492 bp, Homo sapiens; identical to SEQ ID NO: 547805
  misc_feature: HIJSMM301AR51F.48.38.D05.1.454.light.4.raw

SEQ ID NO: 603046 - DNA, 490 bp, Homo sapiens
  misc_feature: HIJSMM301B6FN5.40.83.H06.1.454.light.4.raw
tctagcgactcacgaccggtgctcgatttagatcacgtgcgtcgcggggtctccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgacttattactgttcagcatgggacggcagccctcagtgaatgggtgttcggcgggagggaccaactgtccgtccgtaggtcaccgg

SEQ ID NO: 603047 - DNA, 486 bp, Homo sapiens
  misc_feature: HIJSMM301ARUMP.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggtccaacgggaccgaaggtaggaaatacaaacgaactagtggctgcacca

SEQ ID NO: 603048 - DNA, 505 bp, Homo sapiens
  misc_feature: HIJSMM301EW4FG.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtggaaatacaaacgaaactgtggctgcaccatctgtcttcatcttccccg

SEQ ID NO: 603049 - DNA, 497 bp, Homo sapiens; identical to SEQ ID NO: 535286
  misc_feature: HIJSMM301DNMAU.18.59.F04.1.454.light.4.raw

SEQ ID NO: 603050 - DNA, 486 bp, Homo sapiens; identical to SEQ ID NO: 597343
  misc_feature: HIJSMM301DWMJU.15.1.A01.1.454.light.4.raw

SEQ ID NO: 603051 - DNA, 496 bp, Homo sapiens
  misc_feature: HIJSMM301EMG15.16.71.G05.1.454.light.4.raw
tgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttaccagcaggtacttagcctggtaccagcagaaacctggcctggctcccaggctcctcatctatggtgcatccagcagggccactggcatcccagacaggttcagtggcagtgggtctgggacagacttcactctcaccctcagcagactggagcctgaagattttgcagtgtattactgtcagcagtatggtagggcaccttacacttttggccaggggaccaaagctggagatcaaacgaaactgtggctgcaccatctgtctt

SEQ ID NO: 603052 - DNA, 443 bp, Homo sapiens; identical to SEQ ID NO: 549023
  misc_feature: HIJSMM301BAKIK.8.73.G07.1.454.light.4.raw

SEQ ID NO: 603053 - DNA, 510 bp, Homo sapiens
  misc_feature: HIJSMM301A8TYI.4.10.A10.1.454.light.4.raw
  modified_base (385)..(385): a, c, t, g, unknown or other
agcactgtagcacgaccggtgctcgatttagcgtcgatctcaggggggggtagagaagacaggactcaggacaatctccagcatggccagcttccctctcctcctcaccctcctcactcactgtgcagggtcctgggcccactctgtgctgactcagccaccctcagcgtctggggacccccgggcagagggtcaccatctcttgttctggaagcacctccaacatcggaagtaatcctgtaaactggttccagcaactcccaggaagggcccccaaagtcctcatctatggtcagaatcagcgtccctcaggggtccctgaccgattctctggctccaagtctgacacctcagcctccctggccatcagtgggctccagtctgnggatgaggctgattattacttgtgcaacatgggatgacatcctacgtggtgcggtgttcggcggtagggaccaggttgaccgtctgggtcagccaaggctgccccctcggtcactctgttcccgt

SEQ ID NO: 603054 - DNA, 502 bp, Homo sapiens
  misc_feature: HIJSMM301D9SXM.15.56.F01.1.454.light.4.raw
tctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaactcatgatttatgaggacaatgagcggccctcaggggtttctaatcgcttctctggctccaagtctgacaacacggcctccctgacaatctctgggctccaggctgaggacgagggtgattattactgactgcgcatatagaagtcccactgttgtacttttcggcggagggaccaagctgaccgtcctaggtcagcccaaggctgccccctcggtcactctgttcccgccctcctcgctacgtaga

SEQ ID NO: 603055 - DNA, 488 bp, Homo sapiens
  misc_feature: HIJSMM301CSBO1.47.36.D03.1.454.light.4.raw
agctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaagcccctaacctcctcatctctactgcatccactttgcaaagtggggtcccatcaaggttcagcggcagtggatctgggacagatttcactctcactatcagcagcctgcagcctgaagattttggaacttatattgtcaacagggtaacagtttcccgctcaccttcggcggagggaccaaggtggagatgaaaagaactgtggctgcaccat

SEQ ID NO: 603056 - DNA, 521 bp, Homo sapiens; identical to SEQ ID NO: 539470
  misc_feature: HIJSMM301BKTPV.27.23.C01.1.454.light.4.raw

SEQ ID NO: 603057 - DNA, 514 bp, Homo sapiens; identical to SEQ ID NO: 538541
  misc_feature: HIJSMM301C5QS1.47.23.C01.1.454.light.4.raw

SEQ ID NO: 603058 - DNA, 500 bp, Homo sapiens; identical to SEQ ID NO: 535310
  misc_feature: HIJSMM301EE9GT.47.66.F11.1.454.light.4.raw

SEQ ID NO: 603059 - DNA, 501 bp, Homo sapiens
  misc_feature: HIJSMM301DB79W.43.67.G01.1.454.light.4.raw
tgtgagtagtcacgaccggtgctcgatttagagtatacatattgggtttggggggggtcacaagaggcagcgctctcgggacgtctccaccatggcctgggctctgcccctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctcctgacaatctctgggctccaggctgaggacgaggctgattattattgctgctcatatgcaggtagttacacttatgtcttcggaattgggacgacggtcaccgtcctaggtcagcccaaggccaaccca

SEQ ID NO: 603060 - DNA, 523 bp, Homo sapiens
  misc_feature: HIJSMM301C229Z.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggcctgccccctcggtccactctgttcccaccct

SEQ ID NO: 603061 - DNA, 502 bp, Homo sapiens
  misc_feature: HIJSMM301C3XIE.49.48.E04.1.454.light.4.raw
agtcgagagacacgaccggtgctcgatttagagagcgtcacagagagaagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaatatgcttattggtaccagcagaagtcaggccaggcccctgtactggtcatctacgaggacagtaaacgaccctccgggatccctgcgagattctctgcctctagttcagggacaatggccaccttgactatcagtggggcccaggtggaggatgaagctgactactattgttactcaacagacagcagtgccgagggggtcttcggcggagggaccaagctgaccgtcctaggtcagcccaaggctgccccctcggtcactctcg

SEQ ID NO: 603062 - DNA, 447 bp, Homo sapiens
  misc_feature: HIJSMM301DZNGK.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggccccttgacaacagtttggggtgttttggggtgttcgggcggagggaccaagctgaccgtcctaagtcagccaaggctgcccctcggtcactctgttcccgccctcctccgtgtctgat

SEQ ID NO: 603063 - DNA, 515 bp, Homo sapiens
  misc_feature: HIJSMM301AD6LI.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagccggtgatgaggctgactatttttgtcaggtgtgggacagcagcatttatgtcttcggacctgggaccaaggtcaccgtcctaggtcagcccaaggccaaccccactgtcactctgttcccgccctcctcgac

SEQ ID NO: 603064 - DNA, 469 bp, Homo sapiens
  misc_feature: HIJSMM301D1DP3.4.75.G09.1.454.light.4.raw
agcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataaattgggggataagtatgtttgttggtatcagcagaagccaggccagtcccctgtgctggtcatctattatgataccaagcggccctcagggatccctgagcgattctctggctccaactctgggaacacagccactctgaccatcagcgggacccaggctatggatgaggctgactattactgtcaggcgtgggacagcagcatccctatgtcttcggcactgggaccaaggtcaccgtcctaggtcagccc

SEQ ID NO: 603065 - DNA, 511 bp, Homo sapiens; identical to SEQ ID NO: 544123
  misc_feature: HIJSMM301ATZB3.5.27.C05.1.454.light.4.raw

SEQ ID NO: 603066 - DNA, 446 bp, Homo sapiens
  misc_feature: HIJSMM301BQ8QP.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatctgggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaaccctctgtcactctgttcccaccctcctccatactcgta

SEQ ID NO: 603067 - DNA, 500 bp, Homo sapiens
  misc_feature: HIJSMM301D5X16.48.42.D09.1.454.light.4.raw
  modified_base (404)..(404): a, c, t, g, unknown or other
agtatacatacacgaccggtgctcgatttagacacatacgcagggaaagggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattacngtcatcagacttttagtttacgtcggaccttcggccaagggacacgactggagattaaacgaactgtggctgcaccatctgtcttcatcttccccg

SEQ ID NO: 603068 - DNA, 485 bp, Homo sapiens
  misc_feature: HIJSMM301EY1RK.47.46.E02.1.454.light.4.raw
  modified_base (460)..(460): a, c, t, g, unknown or other
agctcacgtacacgaccggtgctcgatttagactcatctacaggggaaaggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgcagtttattactgtcagcagtatcataactggccgctcaccttcggccaagggacacgactgganattaaacgaactgtggctgcaccat

SEQ ID NO: 603069 - DNA, 519 bp, Homo sapiens
  misc_feature: HIJSMM301BV9V2.43.59.F04.1.454.light.4.raw
tgtgagtagtcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaactttatgaccatgtctcctggtaccaacaatacccaggcaaagcccccaaactcttgatttatgatgtcacttatcggccctcaggggtttcttatcgcttctctggctccaagtctggcaacacggcctccctgaccatctctgggctccaggctgaggacgaggctgattattactgcaactcacttacaacgaccgacacttgcgtattcggcggcgggaccaagctgaccgtctaggtcagcccaaggctcgcccctcggtcactctcgttccccg

SEQ ID NO: 603070 - DNA, 488 bp, Homo sapiens; identical to SEQ ID NO: 537504
  misc_feature: HIJSMM301AZTCJ.17.57.F02.1.454.light.4.raw

SEQ ID NO: 603071 - DNA, 488 bp, Homo sapiens; identical to SEQ ID NO: 535861
  misc_feature: HIJSMM301A84JB.14.55.E11.1.454.light.4.raw

SEQ ID NO: 603072 - DNA, 482 bp, Homo sapiens
  misc_feature: HIJSMM301EF621.52.23.C01.1.454.light.4.raw
cgcagtacgacacgaccggtgctcgatttagtacacgtgattagggattggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactatttaaattggtatcagcagaaaccagggaaagcccctaaactcctgatctacgatgcatccaatttggagacaggggtcccatcaaggttcactggaagtggatctgggacacattttactttcaccatcagcggcctgcagcctgaagattttgcaacatattactgtcaacaatatgaagatctccccctcactttcggcggagggaccaaggtgagatcagacgaactgtggctgcaccat

SEQ ID NO: 603073 - DNA, 500 bp, Homo sapiens; identical to SEQ ID NO: 560122
  misc_feature: HIJSMM301BDHM0.9.81.H04.1.454.light.4.raw

SEQ ID NO: 603074 - DNA, 494 bp, Homo sapiens; identical to SEQ ID NO: 535629
  misc_feature: HIJSMM301DDLBY.4.27.C05.1.454.light.4.raw

SEQ ID NO: 603075 - DNA, 486 bp, Homo sapiens; identical to SEQ ID NO: 535043
  misc_feature: HIJSMM301AHPXS.46.35.D02.1.454.light.4.raw

SEQ ID NO: 603076 - DNA, 502 bp, Homo sapiens
  misc_feature: HIJSMM301CQ2AT.17.27.C05.1.454.light.4.raw
  modified_base (57)..(57): a, c, t, g, unknown or other
cgtagactagcacgaccggtgctcgatttagacgcgatcgaagggtttggggagctntgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgtcgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactggggctcaggcggaagatgaggctgactattactgtaactcccgggacagcagtgctgaccaggtggtattcggcggagggacccacctgaccgtcttaggtcagcccaaggctgccccctcggtcta

SEQ ID NO: 603077 - DNA, 485 bp, Homo sapiens; identical to SEQ ID NO: 536040
  misc_feature: HIJSMM301BCVN7.15.1.A01.1.454.light.4.raw

SEQ ID NO: 603078 - DNA, 502 bp, Homo sapiens
  misc_feature: HIJSMM301CNA0P.43.78.H01.1.454.light.4.raw
tgtgagtagtcacgaccggtgctcgatttagtgtgagtagtttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactctggggtcccagacagattcagcggcagtgggtctggcactgatttcacactgacaatcagcagggtggaggctgaggatgttgggttttattactgcatgcaaacttcacactggcctccgttcacttttggccagaggaccaaggtggagatcaaacgaactgtggctgcacc

SEQ ID NO: 603079 - DNA, 496 bp, Homo sapiens
  misc_feature: HIJSMM301CTIJJ.10.79.H02.1.454.light.4.raw
catagtagtgcacgaccggtgctcgatttagtgtcacacgaagggaaaggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccagggggaccaaggctggagatcaaacgaactgtggctgcaccatctgtctt

SEQ ID NO: 603080 - DNA, 506 bp, Homo sapiens; identical to SEQ ID NO: 539926
  misc_feature: HIJSMM301CNZX6.5.24.C02.1.454.light.4.raw

SEQ ID NO: 603081 - DNA, 490 bp, Homo sapiens
  misc_feature: HIJSMM301AGROF.15.28.C06.1.454.light.4.raw
tctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcagcggcagtggatctgggacagaattcagtctcaccatcagcagcctgcagcctgacgattttgcaacttactactgccaagtgcataataattcatttcggtcggagggacccaaggtaggaggatcaaacgaactgtggctgcaccatctgtcttcat

SEQ ID NO: 603082 - DNA, 492 bp, Homo sapiens
  misc_feature: HIJSMM301AL8KL.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggcggagggaccgaacggtggagatacaaacgaacta

SEQ ID NO: 603083 - DNA, 518 bp, Homo sapiens; identical to SEQ ID NO: 539372
  misc_feature: HIJSMM301DEX18.7.86.H09.1.454.light.4.raw

SEQ ID NO: 603084 - DNA, 515 bp, Homo sapiens
  misc_feature: HIJSMM301EOYTY.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccatttttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtctaggtcagcccaaggctgccccctggtcactctgttcccgcctctcacg

SEQ ID NO: 603085 - DNA, 454 bp, Homo sapiens; identical to SEQ ID NO: 534964
  misc_feature: HIJSMM301BU2A7.19.86.H09.1.454.light.4.raw

SEQ ID NO: 603086 - DNA, 482 bp, Homo sapiens
  misc_feature: HIJSMM301EHSUO.52.4.A04.1.454.light.4.raw
cgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgttctggagataaaatggaggataaatatgtttcctggtatcgccagaagccaggccagtcgcctgtcctggtcatctatcacgataagaagcggccctcagggatccctgagcgattctctggctccaactctgggaacacagccactctgaccatcagcgggacccaggctatggatgaggctgactattactgtcagccgtgggacagaagcactctggtgttcggcggagggaccaggctgaccgtcctaggtcagcccaagggctgccccccg

SEQ ID NO: 603087 - DNA, 503 bp, Homo sapiens; identical to SEQ ID NO: 543231
  misc_feature: HIJSMM301DM7AL.5.86.H09.1.454.light.4.raw

SEQ ID NO: 603088 - DNA, 521 bp, Homo sapiens; identical to SEQ ID NO: 581945
  misc_feature: HIJSMM301BFDTP.27.23.C01.1.454.light.4.raw

SEQ ID NO: 603089 - DNA, 504 bp, Homo sapiens; identical to SEQ ID NO: 536385
  misc_feature: HIJSMM301AXWWF.27.78.H01.1.454.light.4.raw

SEQ ID NO: 603090 - DNA, 492 bp, Homo sapiens
  misc_feature: HIJSMM301DDBQ9.43.29.C07.1.454.light.4.raw
tgtgagtagtcacgaccggtgctcgatttagagtgctacgaagggaaagggggagtcagacccactcaggacacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtggggtcccatcaagattcagcggtagtggatctgggacagaattcactctcaccgtcagcagcctgcagcctgaagatttgcaacttattactgtcaacagtttaataactaccctctcactttcggaggagggaccagggtggagatcaaacgaactgtggctgcaccatctgtcttcta

SEQ ID NO: 603091 - DNA, 516 bp, Homo sapiens
  misc_feature: HIJSMM301EBY4B.17.33.C11.1.454.light.4.raw
  modified_base (466)..(466): a, c, t, g, unknown or other
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaaggctgaccgtnttaagtcagcccaaggctcgccccctcggtcactctgttcccaccctcct

SEQ ID NO: 603092 - DNA, 489 bp, Homo sapiens; identical to SEQ ID NO: 535139
  misc_feature: HIJSMM301A6TIH.14.55.E11.1.454.light.4.raw

SEQ ID NO: 603093 - DNA, 507 bp, Homo sapiens; identical to SEQ ID NO: 599054
  misc_feature: HIJSMM301BY3YL.8.42.D09.1.454.light.4.raw

SEQ ID NO: 603094 - DNA, 501 bp, Homo sapiens; identical to SEQ ID NO: 542520
  misc_feature: HIJSMM301ANDUI.10.43.D10.1.454.light.4.raw

SEQ ID NO: 603095 - DNA, 454 bp, Homo sapiens
  misc_feature: HIJSMM301C726Y.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacgttcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccaccctcctccacgagagta

SEQ ID NO: 603096 - DNA, 507 bp, Homo sapiens; identical to SEQ ID NO: 557429
  misc_feature: HIJSMM301D3UDW.15.59.F04.1.454.light.4.raw

SEQ ID NO: 603097 - DNA, 495 bp, Homo sapiens
  misc_feature: HIJSMM301CJZ98.3.36.D03.1.454.light.4.raw
agacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccaggggagagagccaccctctcctgcggggccagtcagagtgttcccagcaactatatagcctggtaccagcacaaagttggcctggcgcccaggctcctcatctatgatacattcaccagggccactggcatcccggacaggttcagaggcagtgggtatgggacagacttcactctcaccatcagcagactggagcctggagattttgcagtttattactgtcagcagtatggtacttcacaaacctttcggccaggggacacgactggagattaagcgaactgtggctgcaccatctgtctt

SEQ ID NO: 603098 - DNA, 498 bp, Homo sapiens; identical to SEQ ID NO: 547944
  misc_feature: HIJSMM301DYB6L.41.53.E09.1.454.light.4.raw

SEQ ID NO: 603099 - DNA, 506 bp, Homo sapiens
  misc_feature: HIJSMM301CJ13R.8.1.A01.1.454.light.4.raw
ctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacgaccaggatcacctgctctggagatgaattgccaaagaaatatgcttattggtaccagcagaagtcaggccaggcccctgtcctggtcatttatgaggacaagaaacgaccctccgggatccctgacagactctctggctccagctcagggacagtggccaccttgactatcactggggcccaggtggaggatgaaggagactactattgttactctccagagaaggatggtcatcattgggtgttcggcggagggaccaagctgaccgtcctaagtcagcccaaggctgccccctcggtcactctcgttcccaccct

SEQ ID NO: 603100 - DNA, 521 bp, Homo sapiens; identical to SEQ ID NO: 538715
  misc_feature: HIJSMM301ALJEJ.27.23.C01.1.454.light.4.raw

SEQ ID NO: 603101 - DNA, 521 bp, Homo sapiens; identical to SEQ ID NO: 539470
  misc_feature: HIJSMM301A2YHT.27.23.C01.1.454.light.4.raw

SEQ ID NO: 603102 - DNA, 505 bp, Homo sapiens; identical to SEQ ID NO: 546412
  misc_feature: HIJSMM301DQ0H7.22.21.B10.1.454.light.4.raw

SEQ ID NO: 603103 - DNA, 486 bp, Homo sapiens
  misc_feature: HIJSMM301CIEBS.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgtacttattattgccaacagtataagagttattcaactttcggccctgggaccaatgtggatatcaaacgaactgtggctgcaccatctgtt

SEQ ID NO: 603104 - DNA, 516 bp, Homo sapiens
  misc_feature: HIJSMM301CA7OH.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcgggacccagaccctggagcctcagttggaagcagccgatccagcctgcggagcctgtggggcaggtcagcccaaggctgccccctcggtcactctgttcccgcctcctccacg

SEQ ID NO: 603105 - DNA, 485 bp, Homo sapiens
  misc_feature: HIJSMM301BTOXJ.5.39.D06.1.454.light.4.raw
atcagacacgcacgaccggtgctcgatttagtgacatctcgcagttctttggggagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatataatagttattggacgttcggccagggaccaaggtacgaaatagagacgaactgtggctgcaccatctgtctt

SEQ ID NO: 603106 - DNA, 378 bp, Homo sapiens; identical to SEQ ID NO: 577487
  misc_feature: HIJSMM301C1F1H.49.42.D09.1.454.light.4.raw

SEQ ID NO: 603107 - DNA, 503 bp, Homo sapiens; identical to SEQ ID NO: 550542
  misc_feature: HIJSMM301AP2YA.2.76.G10.1.454.light.4.raw

SEQ ID NO: 603108 - DNA, 433 bp, Homo sapiens
  misc_feature: HIJSMM301DY0C0.52.15.B04.1.454.light.4.raw
cgcagtacgacacgaccggtgctcgatttagacagtatatatccgcggggggggtctcaggaggcagcgctctcgggacgtctccaccatggcctgggctctgctattcctcaccctcctcactcagggcacagggtcctgggcccagtctgccctgactcagcctaccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatacacaaacagaaacacttgggtgttcggcggcgggaccaaactgaccgtccttcgtcagcccaaggctgccccctcggtcactctgttcccgaccctcctctatacgatcg

SEQ ID NO: 603109 - DNA, 503 bp, Homo sapiens
  misc_feature: HIJSMM301DTVWF.41.18.B07.1.454.light.4.raw
tctatactatcacgaccggtgctcgatttagtcgctgcgtaaggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttagtcgggtgttcgggcgggggaccaagctgaccgtcctaggtcagcccaaggctcgccccctcggtcactcttccg

SEQ ID NO: 603110 - DNA, 492 bp, Homo sapiens
  misc_feature: HIJSMM301AVY0Q.49.4.A04.1.454.light.4.raw
agtcgagagacacgaccggtgctcgatttagagtagtgatcagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcagcgtagcaactggcctctcactttcggcggagggaccaaggtggaggaatcaaacgaactgtggctgcaccatctgtt

SEQ ID NO: 603111 - DNA, 515 bp, Homo sapiens
  misc_feature: HIJSMM301AL0LQ.15.34.D01.1.454.light.4.raw
tctacgtagccacgaccggtgctcgatttagatcgtctgtgttgggtttggggggaaggcctgagaacacttagccttcatgagtgtccccacccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggcatttgggtgttcggcggaggggaccaaaactgaccgtcctaggtcagcccaaggctgcccccctcggtcact

SEQ ID NO: 603112 - DNA, 488 bp, Homo sapiens
  misc_feature: HIJSMM301E0R65.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgtttcggccaagggaccaaggtaggatatcagacgaa

SEQ ID NO: 603113 - DNA, 505 bp, Homo sapiens
  misc_feature: HIJSMM301CWKST.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatctcccgtcc

SEQ ID NO: 603114 - DNA, 516 bp, Homo sapiens; identical to SEQ ID NO: 535549
  misc_feature: HIJSMM301C8HV1.14.70.G04.1.454.light.4.raw

SEQ ID NO: 603115 - DNA, 491 bp, Homo sapiens; identical to SEQ ID NO: 535176
  misc_feature: HIJSMM301D8K71.13.39.D06.1.454.light.4.raw

SEQ ID NO: 603116 - DNA, 526 bp, Homo sapiens
  misc_feature: HIJSMM301EJNHE.27.23.C01.1.454.light.4.raw
  modified_base (511)..(511): a, c, t, g, unknown or other
agcgtcgtctcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtcccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttggggtgtttcggcggagggaccaggctgaccgtcctaggtcagcccaaggctgccccctcggtccnctctgttcccgccct

SEQ ID NO: 603117 - DNA, 464 bp, Homo sapiens; identical to SEQ ID NO: 537111
  misc_feature: HIJSMM301DI3BA.17.28.C06.1.454.light.4.raw

SEQ ID NO: 603118 - DNA, 486 bp, Homo sapiens; identical to SEQ ID NO: 600643
  misc_feature: HIJSMM301B4O13.22.77.G11.1.454.light.4.raw

SEQ ID NO: 603119 - DNA, 486 bp, Homo sapiens
  misc_feature: HIJSMM301BOP5G.17.26.C04.1.454.light.4.raw
cgtagactagcacgaccggtgctcgatttagtctagcgactttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaggattttgcaacttactactgtcaacagggttacagtaccccgtacacttttggccaggggaccaagctggagatcaaacgaactgtggctgcaccatctgtctt

SEQ ID NO: 603120 - DNA, 447 bp, Homo sapiens; identical to SEQ ID NO: 535020
  misc_feature: HIJSMM301CCLZT.18.9.A09.1.454.light.4.raw

SEQ ID NO: 603121 - DNA, 483 bp, Homo sapiens
  misc_feature: HIJSMM301DFMZY.22.77.G11.1.454.light.4.raw
acatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatcctcccggtctgcatctgttggagaaagaatcaccatcacttgtcgggcaagtcagagcattgatatccttttaaactggtatcatcagagaccagggaaggcccctaagttcctgatccatgatgcatccactctgcagagtggagtcccatccaggttcagtggcagtgggtctgggacagagttcactctcaccatcaacagtctgcagccagaggactttggaacctactattgccaacagacttacacgtacccccccacgttcggcggagggaccacagtcgagatcaaacgaactgtggctgcacat

SEQ ID NO: 603122 - DNA, 521 bp, Homo sapiens; identical to SEQ ID NO: 539470
  misc_feature: HIJSMM301BWMQI.27.23.C01.1.454.light.4.raw

SEQ ID NO: 603123 - DNA, 497 bp, Homo sapiens; identical to SEQ ID NO: 538382
  misc_feature: HIJSMM301CRLYI.3.33.C11.1.454.light.4.raw

SEQ ID NO: 603124 - DNA, 506 bp, Homo sapiens
  misc_feature: HIJSMM301DXP5S.15.66.F11.1.454.light.4.raw
tctacgtagccacgaccggtgctcgatttagtcacgcgagaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcaggggtccctgatcgcttctctggctccaagtctggcgactcggcctccctgaccgtctctgggctccagcctgaagatgaggctgattatttctgcggtttcatatggagacaattacagctttgcttcggaagtggaccaaggtcacgtcctaagtcagcccaaggccaacccactgtcactctgttcccaccctcctcg

SEQ ID NO: 603125 - DNA, 475 bp, Homo sapiens
  misc_feature: HIJSMM301A7D7K.5.15.B04.1.454.light.4.raw
atcagacacgcacgaccggtgctcgatttagacagtatatatccgcgggggagtcagactcagtcaggacacagcatggacatgagggtccccgctcagctcctggggctcctgctgctctggctcccaggtgccaaatgtgacatccagatgacccagtctccttccaccctgtctgcatctataggagacagagtcaccatcacttgccgggccagtcagagtattagtaactggttggcctggtatcagcagaaaccaggcaaagccccaaagctccttatctctgatgcctccactttgcacggtggggtcccaccaacgttcagcggcagtggatctgggacagaattcactctcaccatcagcagcctgcagcctgatgatgctgcaacttattactgtcaacaatataacagttattggacgttggccaagggaccaaggtggaaatcaaacgaactgtgctgcacca

SEQ ID NO: 603126 - DNA, 504 bp, Homo sapiens; identical to SEQ ID NO: 542288
  misc_feature: HIJSMM301EKJ9U.8.28.C06.1.454.light.4.raw

SEQ ID NO: 603127 - DNA, 505 bp, Homo sapiens
  misc_feature: HIJSMM301A4OBM.48.74.G08.1.454.light.4.raw
agtatacatacacgaccggtgctcgatttagtagctctatcaggggaggattcaggacaatctccagcatggccggcttccctctcctcctcaccctcctcactcactgtacagggtcctgggcccagtctgtgctgactcagccaccctcagcgtctgggacccccggacagagggtcaccatctcttgttctggaagcagttccaacatcggaagtaattctgtattctggtaccagcagctcccaggatcggcccccaaattgctcatctatatgaataatcaacggccctttggggtccctgaccgattctctggctccaagtctgacacctcagcctccctggccatcagtgggctccggtccgaggatgaggctgattattactgtgcagcatggatgacagtcatgtgcttttcggcggagggaccaaggtgaccgtcctaggtcagccaagctgccccctcggtcactctgttcccaccctcctcctatgtatactc

SEQ ID NO: 603128 - DNA, 503 bp, Homo sapiens; identical to SEQ ID NO: 549080
  misc_feature: HIJSMM301AVMFH.53.49.E05.1.454.light.4.raw

SEQ ID NO: 603129 - DNA, 492 bp, Homo sapiens
  misc_feature: HIJSMM301DXCMB.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatacgaactgacaaggtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcggtggacgttcggccaagggaccaaggtggatatcagacgaa

SEQ ID NO: 603130 - DNA, 513 bp, Homo sapiens
  misc_feature: HIJSMM301EWW4C.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccaccctct

SEQ ID NO: 603131 - DNA, 495 bp, Homo sapiens; identical to SEQ ID NO: 552391
  misc_feature: HIJSMM301BD8VJ.22.14.B03.1.454.light.4.raw

SEQ ID NO: 603132 - DNA, 447 bp, Homo sapiens; identical to SEQ ID NO: 535020
  misc_feature: HIJSMM301E1S2Y.18.9.A09.1.454.light.4.raw

SEQ ID NO: 603133 - DNA, 499 bp, Homo sapiens; identical to SEQ ID NO: 551769
  misc_feature: HIJSMM301CX320.43.34.D01.1.454.light.4.raw

SEQ ID NO: 603134 - DNA, 486 bp, Homo sapiens; identical to SEQ ID NO: 535043
  misc_feature: HIJSMM301DI73Z.46.35.D02.1.454.light.4.raw

SEQ ID NO: 603135 - DNA, 475 bp, Homo sapiens
  misc_feature: HIJSMM301BULVC.13.71.G05.1.454.light.4.raw
tcacgtactacacgaccggtgctcgatttagtgtcgtcgcaagagagaggggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaattggggataaatatgcttgctggtatcagcagaagccaggccagtcccctgtgctggtcatctatcaagataccaagcggccctcagggatccctgagcgattctctggctccaactctgggaacacagccactctgaccatcagcgggacccaggctgtggatgaggctgactattactgtcaggcgtgggacagcagcactgcctccttcggaactgggaccaaggtcaccgtcctaggtcagcccaaggccaa

SEQ ID NO: 603136 - DNA, 485 bp, Homo sapiens
  misc_feature: HIJSMM301B3AGM.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattatgtcaatcagcagacaacagtaatacttatctttatgtcttcggatctgggaccagggtcaccgtcctaggtcagcccaaggccaaccca

SEQ ID NO: 603137 - DNA, 504 bp, Homo sapiens; identical to SEQ ID NO: 535561
  misc_feature: HIJSMM301ESPU0.4.57.F02.1.454.light.4.raw

SEQ ID NO: 603138 - DNA, 454 bp, Homo sapiens; identical to SEQ ID NO: 535005
  misc_feature: HIJSMM301D5G1K.19.86.H09.1.454.light.4.raw

SEQ ID NO: 603139 - DNA, 511 bp, Homo sapiens; identical to SEQ ID NO: 537464
  misc_feature: HIJSMM301B82M1.7.34.D01.1.454.light.4.raw

SEQ ID NO: 603140 - DNA, 487 bp, Homo sapiens; identical to SEQ ID NO: 544897
  misc_feature: HIJSMM301D5QTX.46.35.D02.1.454.light.4.raw

SEQ ID NO: 603141 - DNA, 492 bp, Homo sapiens
  misc_feature: HIJSMM301A6RQY.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacaggacttcactctcaccatcagcagcctagagcctgaagattttgcactttattactgtcagcagcgtagcaactggcctctcactttcggcggagggaccagggtggagatcagacgaactgtggctgcaccatctgtt

SEQ ID NO: 603142 - DNA, 487 bp, Homo sapiens; identical to SEQ ID NO: 575189
  misc_feature: HIJSMM301EIGP5.26.37.D04.1.454.light.4.raw

SEQ ID NO: 603143 - DNA, 499 bp, Homo sapiens; identical to SEQ ID NO: 594009
  misc_feature: HIJSMM301DW1IY.9.21.B10.1.454.light.4.raw

SEQ ID NO: 603144 - DNA, 505 bp, Homo sapiens; identical to SEQ ID NO: 536117
  misc_feature: HIJSMM301EYAM0.8.71.G05.1.454.light.4.raw

SEQ ID NO: 603145 - DNA, 514 bp, Homo sapiens; identical to SEQ ID NO: 541502
  misc_feature: HIJSMM301C493D.15.34.D01.1.454.light.4.raw

SEQ ID NO: 603146 - DNA, 505 bp, Homo sapiens; identical to SEQ ID NO: 538911
  misc_feature: HIJSMM301AHV8A.9.12.B01.1.454.light.4.raw

SEQ ID NO: 603147 - DNA, 493 bp, Homo sapiens
  misc_feature: HIJSMM301BWIFG.14.64.F09.1.454.light.4.raw
cgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgcctatttaaattggtatcagcaaaaaccagggaaagcccctaacctcctgatctttgatgcatccaatttgcagagtggggtcccatcacgcttcactggcagtggctctgggacagatttcactctcaccatcagcggtctccaacctgaagattttgcaacttactactgtcaacagagttacagtacccccctcactttcggcggaggaccaaggcggagatcagacgaactgtggctgcaccatctgtcttcatcttcccg

SEQ ID NO: 603148 - DNA, 465 bp, Homo sapiens
  misc_feature: HIJSMM301DOKF0.11.70.G04.1.454.light.4.raw
cgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgttgcaacttattactgtcaaaagatagcgctgccccgctcagtttcggcggagggaccaaggtggagatac

SEQ ID NO: 603149 - DNA, 511 bp, Homo sapiens
  misc_feature: HIJSMM301CGQGU.11.57.F02.1.454.light.4.raw
cgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccgaagggaccaaggtggaagtacaagcgaactgtggctgcaccatctgtcttcacttcttcccgcc

SEQ ID NO: 603150 - DNA, 535 bp, Homo sapiens
  misc_feature: HIJSMM301BP7EV.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggacgcctcagttggaagcagccgatccagcctgcggagcctggtggggcgaggtcacggcccaaggcctcggcccccctcggtccactcctcgttccccgcccctccctcccaccg

SEQ ID NO: 603151 - DNA, 505 bp, Homo sapiens
  misc_feature: HIJSMM301DL8XK.4.10.A10.1.454.light.4.raw
agcactgtagcacgaccggtgctcgatttagcgtcgatctcagggggggtagagaagacaggactcaggacaatctccagcatggccagcttccctctcctcctcaccctcctcactcactgtgcagggtcctgggcccactctgtgctgactcagccaccctcagcgtctgggacccccggcagagggtcaccatctcttgttctggaagcacctccaacatcggaagtaatcctgtaaactggttccagcaactcccaggaagggcccccaaagtcctcatctatggtcagaatcagcgtccctcaggggtccctgaccgattctctggctccaagtctgacacctcagcctccctggccatcagtgggctccagtctgaggatgaggctgattattactgtgcaacatgggatgacatcctacgtggtgcggtgttcggcggagggaccaagtgaccgtcctgggtcagcccaaggctgccccctcggtcactctgttccca

SEQ ID NO: 603152 - DNA, 499 bp, Homo sapiens
  misc_feature: HIJSMM301C8R23.43.13.B02.1.454.light.4.raw
tgtgagtagtcacgaccggtgctcgatttagtctagcgactagcaacacacaaagggggaagagctgctcagttaggacccagagggaaccatggaaaccccagcgcagcttctcttcctcctgctactctggctcccagataccaccggagaaattgtgttgacgcagtctccaggcaccgtgtctttgtctccaggggaaagagccaccttctcttgcagggccagtcagagtgttagcagcaactacttagcctggtaccagcagaaacctggccaggctcccaggctcctcatctatggtgcatccaccagggccactggcatcccagacagattcagtggcactgggtctgggacagacttcactctcaccatcagcagactggaacctgaagattttgcaatttattactgtcagcagtatgcctggtcgcctccggccctcactttcggcggagggaccgaaggtggaggatcaaacgaacctagttggctg

SEQ ID NO: 603153 - DNA, 499 bp, Homo sapiens; identical to SEQ ID NO: 539754
  misc_feature: HIJSMM301DBMO3.11.21.B10.1.454.light.4.raw

SEQ ID NO: 603154 - DNA, 454 bp, Homo sapiens; identical to SEQ ID NO: 536347
  misc_feature: HIJSMM301B7GCE.19.86.H09.1.454.light.4.raw

SEQ ID NO: 603155 - DNA, 481 bp, Homo sapiens; identical to SEQ ID NO: 535993
  misc_feature: HIJSMM301DXOTS.21.25.C03.1.454.light.4.raw

SEQ ID NO: 603156 - DNA, 483 bp, Homo sapiens; identical to SEQ ID NO: 535317
  misc_feature: HIJSMM301C2BTX.4.1.A01.1.454.light.4.raw

SEQ ID NO: 603157 - DNA, 489 bp, Homo sapiens; identical to SEQ ID NO: 535139
  misc_feature: HIJSMM301C6D3E.14.55.E11.1.454.light.4.raw

SEQ ID NO: 603158 - DNA, 489 bp, Homo sapiens
  misc_feature: HIJSMM301BHBID.15.8.A08.1.454.light.4.raw
tctacgtagccacgaccggtgctcgatttagcatactctacagggggaggaactgctcagttaggacccagacggaaccatggaagccccagcgcagcttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgcagtctgaagattttgcagtttattactgtcagcaatataacaagtgccattcactttcggcccagggaccaaagtggatatcaaacgaactgtggctgccaccatctgtcttcat

SEQ ID NO: 603159 - DNA, 490 bp, Homo sapiens; identical to SEQ ID NO: 579622
  misc_feature: HIJSMM301EMD76.16.68.G02.1.454.light.4.raw

SEQ ID NO: 603160 - DNA, 487 bp, Homo sapiens
  misc_feature: HIJSMM301EIHC0.4.66.F11.1.454.light.4.raw
agcactgtagcacgaccggtgctcgatttagtcacgcgagaagggaaaggggcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagcctgggcgagcccctaaactcctgatctatggtgcatcaagtctgcaaagtggggtcccatcgaggttcagaggcagtggatctgggacagatttcactctcaccatcagcggcctgcagcctgaagattatgcaacttactattgtcagagttctaattctttcccgcgcacgtttggccaggggaccaaggtagagatcaaacgaactgtggctgcaccatctgtcttcatcttccccg

SEQ ID NO: 603161 - DNA, 496 bp, Homo sapiens
  misc_feature: HIJSMM301DTCNZ.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggcctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaagg

SEQ ID NO: 603162 - DNA, 454 bp, Homo sapiens; identical to SEQ ID NO: 534964
  misc_feature: HIJSMM301ASA72.19.86.H09.1.454.light.4.raw

SEQ ID NO: 603163 - DNA, 488 bp, Homo sapiens; identical to SEQ ID NO: 602899
  misc_feature: HIJSMM301E2UGS.19.71.G05.1.454.light.4.raw

SEQ ID NO: 603164 - DNA, 517 bp, Homo sapiens
  misc_feature: HIJSMM301B8J10.53.19.B08.1.454.light.4.raw
cgcgtatacacacgaccggtgctcgatttagtgagtcagtaaggggctgggcctaaggaagcagcactggtggtgcctcagccatggcctggaccgttctcctcctcggcctcctctctcactgcacaggttctgtgaccccctatgtcctgactcagccaccctcggtgtcggtggccccaggacaggcggccaccattacctgtgggggagactacattggacgtaaaagtgtgcactggtaccagcaccagccaggccaggcccctatgatgctcctctatgacgatacccaccggccctcagggatccctgagcgattctctggctccaactctgagaacacggccaccctgaccatcagtgggtcgaggccggggatgaggccgtctattactgtcaggtgtgggatagtagtggtgatctgtgggtgttcggcggagggaccacgctgaccgtcctaggtcagcccaaggctgccccctcggtcactctgttcccaccctcctctcgtact

SEQ ID NO: 603165 - DNA, 495 bp, Homo sapiens
  misc_feature: HIJSMM301EXLI9.4.20.B09.1.454.light.4.raw
agcactgtagcacgaccggtgctcgatttagtgtagtgtgaagggggagctacaacaggcaggcaggggcagcaagatggtgttgcagacccaggtcttcatttctctgttgctctggatctctggtgcctacggggacatcgtgatgacccagtctccggactccctggctgtgtctctgggcgagagggccaccatcaactgcaagtccagccagagtgttttatacaactccaacaataagaactacttagcttggtaccagcagagaccaggacagcctcctaagctgctcatttactgggcatctacccgggaatccggggtccctgaccgattcagtggcagcgggtctgggacagatttcactctcgccatcagcagcctgcagcctgacgatgtggcagtttattactgccagcaatattatactgacccgtggacgttcgccgaaggaccaacggtggaaatcaaacgaactagtggctgcaccat

SEQ ID NO: 603166 - DNA, 493 bp, Homo sapiens; identical to SEQ ID NO: 544554
  misc_feature: HIJSMM301A9JF0.10.17.B06.1.454.light.4.raw

SEQ ID NO: 603167 - DNA, 528 bp, Homo sapiens
  misc_feature: HIJSMM301C6RET.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtcgacggaccgaacggtacggaaggtacgaaacgaaacgtacgtaggcgtgcgaccactactgtcttctactcttcctccctactctcgta

SEQ ID NO: 603168 - DNA, 515 bp, Homo sapiens
  misc_feature: HIJSMM301DBGNF.7.34.D01.1.454.light.4.raw
cgtgtctctacacgaccggtgctcgatttagatcgtctgtgttgggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacagcattatttgggtgttcggcggagggaccaagctgaccgtcctgcgtcggcccaaggctgccccctcggtcactctcg

SEQ ID NO: 603169 - DNA, 499 bp, Homo sapiens
  misc_feature: HIJSMM301B0M5U.48.35.D02.1.454.light.4.raw
agtatacatacacgaccggtgctcgatttagcacacgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagccaaggctgccccctc

SEQ ID NO: 603170 - DNA, 496 bp, Homo sapiens; identical to SEQ ID NO: 567909
  misc_feature: HIJSMM301D5N7P.51.81.H04.1.454.light.4.raw

SEQ ID NO: 603171 - DNA, 492 bp, Homo sapiens
  misc_feature: HIJSMM301B16D6.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaacaccttcggccaaggacacgactggagattaaaggaactgtggctgcaccatctgtcttcatcttccccg

SEQ ID NO: 603172 - DNA, 496 bp, Homo sapiens; identical to SEQ ID NO: 576396
  misc_feature: HIJSMM301AUB4G.51.71.G05.1.454.light.4.raw

SEQ ID NO: 603173 - DNA, 496 bp, Homo sapiens; identical to SEQ ID NO: 537925
  misc_feature: HIJSMM301DHYIR.22.14.B03.1.454.light.4.raw

SEQ ID NO: 603174 - DNA, 504 bp, Homo sapiens; identical to SEQ ID NO: 535561
  misc_feature: HIJSMM301A8C7Y.4.57.F02.1.454.light.4.raw

SEQ ID NO: 603175 - DNA, 494 bp, Homo sapiens
  misc_feature: HIJSMM301ELZ83.43.29.C07.1.454.light.4.raw
tgtgagtagtcacgaccggtgctcgatttagagtgctacgaagggaaagggggagtcagacccactcaggacacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtggggtcccatcaagattcagcggtagtggatctgggacagaattcactctcaccgtcagcagcctgcagcctgaagattttgcaacttattactgtcaacagtttaataactaccctctcactttcggaggagggaccagggtggagatacaaacgaactgtggctgcaccatctgtcttcta

SEQ ID NO: 603176 - DNA, 509 bp, Homo sapiens; identical to SEQ ID NO: 553073
  misc_feature: HIJSMM301CNU1T.16.1.A01.1.454.light.4.raw

SEQ ID NO: 603177 - DNA, 521 bp, Homo sapiens; identical to SEQ ID NO: 538715
  misc_feature: HIJSMM301D5HYQ.27.23.C01.1.454.light.4.raw

SEQ ID NO: 603178 - DNA, 491 bp, Homo sapiens; identical to SEQ ID NO: 575601
  misc_feature: HIJSMM301DNFK7.14.55.E11.1.454.light.4.raw

SEQ ID NO: 603179 - DNA, 488 bp, Homo sapiens; identical to SEQ ID NO: 567348
  misc_feature: HIJSMM301EK9D1.14.55.E11.1.454.light.4.raw

SEQ ID NO: 603180 - DNA, 495 bp, Homo sapiens
  misc_feature: HIJSMM301BMK6Y.53.11.A11.1.454.light.4.raw
cgcgtatacacacgaccggtgctcgatttagctacgactgcagggggtgtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaacaatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactattactgtcaatctgcggacagcagtggttctcatgtggtattcggcggagggaccaagctgaccgtcctaggtcagcccaaggctgccccctcggtcactc

SEQ ID NO: 603181 - DNA, 509 bp, Homo sapiens; identical to SEQ ID NO: 548681
  misc_feature: HIJSMM301B1LQ3.47.83.H06.1.454.light.4.raw

SEQ ID NO: 603182 - DNA, 487 bp, Homo sapiens; identical to SEQ ID NO: 558047
  misc_feature: HIJSMM301EAU4C.4.26.C04.1.454.light.4.raw

SEQ ID NO: 603183 - DNA, 504 bp, Homo sapiens
  misc_feature: HIJSMM301BNK5Z.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcacccatcaatagcctggaagctgaagatgctgcaacttatactgtcatcagagtactactttacctcaagtgatcaccttcggccaagggacacgactggagattaaaacg

SEQ ID NO: 603184 - DNA, 486 bp, Homo sapiens; identical to SEQ ID NO: 551175
  misc_feature: HIJSMM301A7TQR.41.33.C11.1.454.light.4.raw

SEQ ID NO: 603185 - DNA, 490 bp, Homo sapiens
  misc_feature: HIJSMM301DUR84.48.67.G01.1.454.light.4.raw
agtatacatacacgaccggtgctcgatttagagtatacatattgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccggcagaagacgaggctgactactattgtcagtcaggagacaatactcgcacgcaagtactgttcggcggagggaccaagctgacagtcctaggtcagcccaaggctgcccccc

SEQ ID NO: 603186 - DNA, 494 bp, Homo sapiens; identical to SEQ ID NO: 534992
  misc_feature: HIJSMM301D730P.9.1.A01.1.454.light.4.raw

SEQ ID NO: 603187 - DNA, 497 bp, Homo sapiens; identical to SEQ ID NO: 535286
  misc_feature: HIJSMM301CWO3X.18.59.F04.1.454.light.4.raw

SEQ ID NO: 603188 - DNA, 490 bp, Homo sapiens; identical to SEQ ID NO: 562759
  misc_feature: HIJSMM301BO8ZW.19.71.G05.1.454.light.4.raw

SEQ ID NO: 603189 - DNA, 447 bp, Homo sapiens; identical to SEQ ID NO: 535020
  misc_feature: HIJSMM301AN9OO.18.9.A09.1.454.light.4.raw

SEQ ID NO: 603190 - DNA, 507 bp, Homo sapiens; identical to SEQ ID NO: 538063
  misc_feature: HIJSMM301A4OJD.47.85.H08.1.454.light.4.raw

SEQ ID NO: 603191 - DNA, 494 bp, Homo sapiens; identical to SEQ ID NO: 534994
  misc_feature: HIJSMM301B5H4U.27.78.H01.1.454.light.4.raw

SEQ ID NO: 603192 - DNA, 491 bp, Homo sapiens; identical to SEQ ID NO: 535194
  misc_feature: HIJSMM301BMJWK.26.78.H01.1.454.light.4.raw

SEQ ID NO: 603193 - DNA, 447 bp, Homo sapiens; identical to SEQ ID NO: 535882
  misc_feature: HIJSMM301AJFTS.18.9.A09.1.454.light.4.raw
  modified_base (429)..(429): a, c, t, g, unknown or other

SEQ ID NO: 603194 - DNA, 521 bp, Homo sapiens; identical to SEQ ID NO: 539470
  misc_feature: HIJSMM301ER5CY.27.23.C01.1.454.light.4.raw

SEQ ID NO: 603195 - DNA, 490 bp, Homo sapiens; identical to SEQ ID NO: 550493
  misc_feature: HIJSMM301A5WP2.10.59.F04.1.454.light.4.raw

SEQ ID NO: 603196 - DNA, 493 bp, Homo sapiens; identical to SEQ ID NO: 536471
  misc_feature: HIJSMM301AJ3RU.3.71.G05.1.454.light.4.raw

SEQ ID NO: 603197 - DNA, 516 bp, Homo sapiens
  misc_feature: HIJSMM301DRH8G.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcgccaaggaccaaggtggcaatcaaccgaactgtggctgcaccatctgtcttcatcttccccg

SEQ ID NO: 603198 - DNA, 513 bp, Homo sapiens
  misc_feature: HIJSMM301AIVPJ.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgtcccaccctcct

SEQ ID NO: 603199 - DNA, 509 bp, Homo sapiens
  misc_feature: HIJSMM301ENSI3.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgagatgttgcagtttattactgtcaacatcgtaccgagtggcctccgggggccactttcggccctcgggaccaaggtggagatcaaacgaactagtggctgcaccatctgtcttcta

SEQ ID NO: 603200 - DNA, 487 bp, Homo sapiens
  misc_feature: HIJSMM301AKC54.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaaccttcggccaggggacacgactggagattaaacgaactgtggctgcaccactctgtt

SEQ ID NO: 603201 - DNA, 523 bp, Homo sapiens
  misc_feature: HIJSMM301A8LCW.41.19.B08.1.454.light.4.raw
tctatactatcacgaccggtgctcgatttagtgagtcagtaaggggggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaacccccactcgtcactctgttccccaccctcctcat

SEQ ID NO: 603202 - DNA, 521 bp, Homo sapiens
  misc_feature: HIJSMM301CQCAF.16.78.H01.1.454.light.4.raw
  modified_base (478)..(478): a, c, t, g, unknown or other
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttatttactgtcagcagtataataactaggccgtcctaccggtaccaactttcggtctacgggaccggaacggaccgngaggagataacgaaactaagtaggtacgtgcgccacactcttc

SEQ ID NO: 603203 - DNA, 488 bp, Homo sapiens; identical to SEQ ID NO: 535861
  misc_feature: HIJSMM301D1BP9.14.55.E11.1.454.light.4.raw

SEQ ID NO: 603204 - DNA, 508 bp, Homo sapiens; identical to SEQ ID NO: 535835
  misc_feature: HIJSMM301BLCDF.8.34.D01.1.454.light.4.raw

SEQ ID NO: 603205 - DNA, 464 bp, Homo sapiens; identical to SEQ ID NO: 592131
  misc_feature: HIJSMM301D6EL3.26.78.H01.1.454.light.4.raw
  modified_base (458)..(458): a, c, t, g, unknown or other

SEQ ID NO: 603206 - DNA, 498 bp, Homo sapiens
  misc_feature: HIJSMM301AJCWR.22.9.A09.1.454.light.4.raw
acatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtgggtctggaagagacttcactctcaccatcaacagcctagagcctgacgattctgcagtttattactgtcagcagcgtaccaagtggcctccgacttttggccgagggggccaagctggagatcagacgaactgtggctgcaccatctgtcttcatcttccccg

SEQ ID NO: 603207 - DNA, 494 bp, Homo sapiens
  misc_feature: HIJSMM301B0S4E.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaaactgtgctgcaccatctgtctt

SEQ ID NO: 603208 - DNA, 490 bp, Homo sapiens
  misc_feature: HIJSMM301EKJIZ.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggaggaccaaggtggagatcaaacgactgtggctgcaccatctgtcttcatcttcccgccat

SEQ ID NO: 603209 - DNA, 521 bp, Homo sapiens; identical to SEQ ID NO: 539470
  misc_feature: HIJSMM301DD4BQ.27.23.C01.1.454.light.4.raw

SEQ ID NO: 603210 - DNA, 499 bp, Homo sapiens
  misc_feature: HIJSMM301CYXNI.9.34.D01.1.454.light.4.raw
tgatacgtctcacgaccggtgctcgatttagatcgtctgtgttgggtttggggacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtaacatcgtcttcggaactgggaccaaggtcaccgtcctgggtcagcccaaggccaacccactgt

SEQ ID NO: 603211 - DNA, 505 bp, Homo sapiens
  misc_feature: HIJSMM301BJ8FZ.48.25.C03.1.454.light.4.raw
agtatacatacacgaccggtgctcgatttagtagtgtagatttgggtttgggggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtgtcccagccaggttcactggcggtgggtctgggacagagttcactctcaccatcagcagcctgcagtctgaagattttacattttattactgtcagcagtatcgtaagtggactccgacgtttggccaagggaccaaggtggaagtcaaacgaactgtggctgcaccatctgtcttcatccttcccgccat

SEQ ID NO: 603212 - DNA, 491 bp, Homo sapiens; identical to SEQ ID NO: 539402
  misc_feature: HIJSMM301EJGJT.13.5.A05.1.454.light.4.raw

SEQ ID NO: 603213 - DNA, 498 bp, Homo sapiens; identical to SEQ ID NO: 562302
  misc_feature: HIJSMM301EJ25Z.41.3.A03.1.454.light.4.raw

SEQ ID NO: 603214 - DNA, 475 bp, Homo sapiens
  misc_feature: HIJSMM301B8UWH.40.61.F06.1.454.light.4.raw
tctagcgactcacgaccggtgctcgatttagctacgctctaagggaaaggggcagtcaggacacagcatggacatgagagtcctcgctcagctcctggggctcctgctgctctgtttcccaggtgccagatgtgacatccagatgacccagtctccatcctcactgtctgcatctgtaggagacagagtcaccatcacttgtcgggcgagtcaagacattagcaactacttagcctggtttcagcagaaaccagggaaagcccctaagtccctgatctctgctgcatccaatttgcaaagtggggtcccatcgagattcagcggcagtggatctggaacaaatttcactctcaccatcaacagcctgcagactggagattttggaacttatactgccaacattataatactttccctcttcactttcggcggaggaccgacggtggagatcagacgaactgtggctgcaccatct

SEQ ID NO: 603215 - DNA, 489 bp, Homo sapiens; identical to SEQ ID NO: 543840
  misc_feature: HIJSMM301ATGTX.12.88.H11.1.454.light.4.raw

SEQ ID NO: 603216 - DNA, 468 bp, Homo sapiens
  misc_feature: HIJSMM301BM85A.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcacttcgccctggactgaagtgcatatgaagagaactgtgg

SEQ ID NO: 603217 - DNA, 509 bp, Homo sapiens
  misc_feature: HIJSMM301CJ4SL.8.33.C11.1.454.light.4.raw
ctcgcgtgtccacgaccggtgctcgatttagagtgagctcgttgggtttggggggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggccgtccgggggccactttcggcccgtcgggaccgaaggtggagatacaaacgaactgtggctgcaccatctgtcttc

SEQ ID NO: 603218 - DNA, 515 bp, Homo sapiens
  misc_feature: HIJSMM301DAV44.9.12.B01.1.454.light.4.raw
  modified_base (432)..(432): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaaactagtttttcncggggtcgttcggccgaacgggaccgaaggtaggaaatacaaacgaactagtggctgcaccatcctgtcttctatcttccccg

SEQ ID NO: 603219 - DNA, 520 bp, Homo sapiens; identical to SEQ ID NO: 564638
  misc_feature: HIJSMM301CET4B.5.27.C05.1.454.light.4.raw

SEQ ID NO: 603220 - DNA, 454 bp, Homo sapiens; identical to SEQ ID NO: 536943
  misc_feature: HIJSMM301A7GLF.19.86.H09.1.454.light.4.raw

SEQ ID NO: 603221 - DNA, 514 bp, Homo sapiens
  misc_feature: HIJSMM301AEY95.43.59.F04.1.454.light.4.raw
tgtgagtagtcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgaccatctctgggctccaggctgaggacgaggctgattattactgcaactcacttacaacgaccgacacttgcgtattcggcggcgggaccaagctgaccgtcctaggtcagcccaaggctgccccctcggtcactctcgtt

SEQ ID NO: 603222 - DNA, 514 bp, Homo sapiens; identical to SEQ ID NO: 545978
  misc_feature: HIJSMM301AHC4J.17.33.C11.1.454.light.4.raw

SEQ ID NO: 603223 - DNA, 519 bp, Homo sapiens
  misc_feature: HIJSMM301E4QBP.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggacaaagctcgccctgacactgtctggtgtgcagcctgaggacgaggctgactattactgcctactctactttggtggtgctgtgctattcggcgggagggaccaagctcgaccgtccttaagtcagcccaacggctcgccccctccggtctactctgttcccta

SEQ ID NO: 603224 - DNA, 441 bp, Homo sapiens; identical to SEQ ID NO: 534971
  misc_feature: HIJSMM301EEA74.11.3.A03.1.454.light.4.raw

SEQ ID NO: 603225 - DNA, 490 bp, Homo sapiens
  misc_feature: HIJSMM301EVJG6.52.52.E08.1.454.light.4.raw
cgcagtacgacacgaccggtgctcgatttagtcgagctctcagagagaaaggggtgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgcacacagtgatggaaacacctacttgaattggtttcagcagaggccaggccaatctccaaggcgcctaatttataaggtttctcaccgggactctggggtcccagacagattcagcggcagtgggtcaggcactgatttcacgctgaaaatcagcagggtggaggctgaagatgttggggtttattactgcatgcaaggcacacactggcctgcgtacacttttggccaggggaccaagctggagaggaaacgaact

SEQ ID NO: 603226 - DNA, 491 bp, Homo sapiens
  misc_feature: HIJSMM301BDXI8.43.36.D03.1.454.light.4.raw
tgtgagtagtcacgaccggtgctcgatttagctgcgtcacgatctctcttgggggagctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtactccccccacccatcagcacgccttagcctggtaccagcacaagtcagggcagcctcctaagttgctcttttactggacttcgatccgcgcatctggggtccctgaccgattcatgggcagcggctctgggacagacttcgctctcaccatcaacagcctccaggctgaggatggcggtcggtttattattgtcaacaatattttagtgctccgtacacttttggccaggggaccaaggttggagatcaaacgaa

SEQ ID NO: 603227 - DNA, 485 bp, Homo sapiens
  misc_feature: HIJSMM301CNR1H.15.49.E05.1.454.light.4.raw
tctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagtattttgctagtttattactgtcagcagtataatgactggcctccgacgttcggcaaggaccaggtggaatcaacgaactgtggctgcaccat

SEQ ID NO: 603228 - DNA, 505 bp, Homo sapiens
  misc_feature: HIJSMM301CXBUP.48.15.B04.1.454.light.4.raw
agtatacatacacgaccggtgctcgatttagacagtatatatccgcggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggtcaccatcaactgcaagtccagccagagtgtttttcacacctccatgaacaaggagtacttggcttggttccagcagaaaccagggcagcctcctaaactactcatttactcggcatccacccggaagtccgaggttcctgaccgattccgtggcagcgggtctgggacagattttactctcaccatcactaccctgcaggctgaagatgtggcagtttattactgtcaacaatattattctactccgccgacgttcggccggggaccaacgtggaatcaaacgaactgtggctgcaccatctgtcttcta

SEQ ID NO: 603229 - DNA, 493 bp, Homo sapiens; identical to SEQ ID NO: 590593
  misc_feature: HIJSMM301B6BSI.18.11.A11.1.454.light.4.raw

SEQ ID NO: 603230 - DNA, 494 bp, Homo sapiens; identical to SEQ ID NO: 534992
  misc_feature: HIJSMM301B9LLO.9.1.A01.1.454.light.4.raw

SEQ ID NO: 603231 - DNA, 482 bp, Homo sapiens; identical to SEQ ID NO: 535352
  misc_feature: HIJSMM301DTIC0.16.81.H04.1.454.light.4.raw

SEQ ID NO: 603232 - DNA, 486 bp, Homo sapiens; identical to SEQ ID NO: 535043
  misc_feature: HIJSMM301AL9ZR.46.35.D02.1.454.light.4.raw

SEQ ID NO: 603233 - DNA, 495 bp, Homo sapiens; identical to SEQ ID NO: 539489
  misc_feature: HIJSMM301DPW64.51.59.F04.1.454.light.4.raw

SEQ ID NO: 603234 - DNA, 508 bp, Homo sapiens
  misc_feature: HIJSMM301B153C.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggccaagggaccaaggtaggaaagtacaaacgaactacgtggctgcaccatctgtcttcatcttccccg

SEQ ID NO: 603235 - DNA, 515 bp, Homo sapiens
  misc_feature: HIJSMM301DSAG4.3.87.H10.1.454.light.4.raw
agacgcactccacgaccggtgctcgatttagcagtactgcgttgggtttggggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttgtctcctggtcctggtaccaaaacacccaggcaaagcccccagattaatgatttatgatgtcagtgatcggccctcaggggtttctcatcgcttttctggctccaagtctggcaacacggcctccctgaccatctctgggctccaggctgaggacgaggctgattatttctgcagctcatacacaaccggcaccactgtcgtggttttcggtggagggaccaagctgaccgtcctaggtcagccaaggctgccccctcggtcact

SEQ ID NO: 603236 - DNA, 454 bp, Homo sapiens; identical to SEQ ID NO: 534964
  misc_feature: HIJSMM301DDMFI.19.86.H09.1.454.light.4.raw

SEQ ID NO: 603237 - DNA, 521 bp, Homo sapiens; identical to SEQ ID NO: 539470
  misc_feature: HIJSMM301B7XVQ.27.23.C01.1.454.light.4.raw

SEQ ID NO: 603238 - DNA, 485 bp, Homo sapiens; identical to SEQ ID NO: 536040
  misc_feature: HIJSMM301BN28Q.15.1.A01.1.454.light.4.raw

SEQ ID NO: 603239 - DNA, 491 bp, Homo sapiens; identical to SEQ ID NO: 536988
  misc_feature: HIJSMM301CJ1A1.17.21.B10.1.454.light.4.raw

SEQ ID NO: 603240 - DNA, 484 bp, Homo sapiens; identical to SEQ ID NO: 535240
  misc_feature: HIJSMM301B3BX0.47.60.F05.1.454.light.4.raw

SEQ ID NO: 603241 - DNA, 477 bp, Homo sapiens
  misc_feature: HIJSMM301EA3ZL.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaaggaaaagacccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggcctgggactgaagtgcatatgaagagaactgtggctgca

SEQ ID NO: 603242 - DNA, 497 bp, Homo sapiens; identical to SEQ ID NO: 536371
  misc_feature: HIJSMM301CBJVD.16.78.H01.1.454.light.4.raw

SEQ ID NO: 603243 - DNA, 495 bp, Homo sapiens; identical to SEQ ID NO: 557386
  misc_feature: HIJSMM301DL0JT.27.78.H01.1.454.light.4.raw

SEQ ID NO: 603244 - DNA, 485 bp, Homo sapiens; identical to SEQ ID NO: 535688
  misc_feature: HIJSMM301BYDBO.19.5.A05.1.454.light.4.raw

SEQ ID NO: 603245 - DNA, 447 bp, Homo sapiens; identical to SEQ ID NO: 535201
  misc_feature: HIJSMM301AVEVB.18.9.A09.1.454.light.4.raw

SEQ ID NO: 603246 - DNA, 494 bp, Homo sapiens; identical to SEQ ID NO: 534994
  misc_feature: HIJSMM301B01BP.27.78.H01.1.454.light.4.raw

SEQ ID NO: 603247 - DNA, 447 bp, Homo sapiens; identical to SEQ ID NO: 535201
  misc_feature: HIJSMM301EM25K.18.9.A09.1.454.light.4.raw

SEQ ID NO: 603248 - DNA, 485 bp, Homo sapiens
  misc_feature: HIJSMM301CO8II.4.27.C05.1.454.light.4.raw
agcactgtagcacgaccggtgctcgatttagacgcgatcgaagggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcgtcctacatagtaatggatacaactatttggattggtacctgcagaagccagggcagtctccacagctcctgatctatttgggttctaaccgggcctccggggtccctgacaggttcagtggcagtggatcaggcacagattttacactgagaatcagcagagtggaggctgaggatgttggggtttactactgcatgcaagctctacaaagccacctacacttttggccaggggaccaaggctggagatcaaacgaaa

SEQ ID NO: 603249 - DNA, 513 bp, Homo sapiens
  misc_feature: HIJSMM301DB7LZ.41.30.C08.1.454.light.4.raw
tctatactatcacgaccggtgctcgatttagtctgacgtcaaagggaaaggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgattaccatctcctgctctgggatcaacagcgaccttggtggttataactatgtgtcctggtaccaacaatatccaggcaaacccccaaagtcatcatttatgatgtcggtagtcggccctccggggtctctagtcgcttctctggctccaagtccggcaacacggcctccctgaccatctctgggctccaggctgaggacgaggctgactattactgcagttcatatacaagcagcagcactggagtcttcggaactgggaccagggtcaccgtcctaggtcagcccaaggccaaccccactgtcactctgtt

SEQ ID NO: 603250 - DNA, 493 bp, Homo sapiens
  misc_feature: HIJSMM301BVK5A.5.57.F02.1.454.light.4.raw
atcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagcctaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacatgtggtcaatggcctcgaacgttcggcccagggaccacagtggatatcaggcgaactgtggctgcaccatctgtctt

SEQ ID NO: 603251 - DNA, 490 bp, Homo sapiens; identical to SEQ ID NO: 535526
  misc_feature: HIJSMM301BK01Q.26.78.H01.1.454.light.4.raw

SEQ ID NO: 603252 - DNA, 503 bp, Homo sapiens; identical to SEQ ID NO: 584187
  misc_feature: HIJSMM301EYF6F.21.81.H04.1.454.light.4.raw

SEQ ID NO: 603253 - DNA, 518 bp, Homo sapiens
  misc_feature: HIJSMM301ELGE8.51.27.C05.1.454.light.4.raw
cgatcgtatacacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaggcaaagcccccaaactcatgatttatgatgtcagtgatcggccctcaggggtttcgaatcgcttctctggctccaagtccggcaacacggcctccctgaccatctctgggctccagggccgaggacgaggctgattattactgcacctcatatacaagcagcaacaattgggtgttcggcggagggaccaagctgaccgtcctaggtcagcccaaggctgccccctcggtcactctgttccccg

SEQ ID NO: 603254 - DNA, 500 bp, Homo sapiens
  misc_feature: HIJSMM301AY57I.40.36.D03.1.454.light.4.raw
tctagcgactcacgaccggtgctcgatttagctgcgtcacgatctctcttgggggctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacaatattattatactccgccgacgttcggccggggaccgaacgtggaaatcaaacgaactagtggctgcacca

SEQ ID NO: 603255 - DNA, 498 bp, Homo sapiens
  misc_feature: HIJSMM301AR8HS.43.49.E05.1.454.light.4.raw
tgtgagtagtcacgaccggtgctcgatttagagcgactagcaacacacaaagggggaagagctgctcagttaggacccagagggaaccatggaaaccccagcgcagcttctcttcctcctgctactctggctcccagataccaccggagaaattgtgttgacgcagtctccaggcaccgtgtctttgtctccaggggaaagagccaccttctcttgcagggccagtcagagtgttagcagcaactacttagcctggtaccagcagaaacctggccaggctcccaggctcctcatctatggtgcatccaccagggccactggcatcccagacagattcagtggcactgggtctgggacagacttcactctcaccatcagcagactggaacctgaagattttgcaatttattactgtcaccagtatggtagctcacctaagacgttcggccaagggaccaaggtggaaatcaaacgaactgtggctgcaccatctgtctt

SEQ ID NO: 603256 - DNA, 494 bp, Homo sapiens
  misc_feature: HIJSMM301BEBQM.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactacttacctcaagtgatcaccttcggccaagggacacgactggagattaaaacgaactgtggctgcaccatctgtctt

SEQ ID NO: 603257 - DNA, 484 bp, Homo sapiens; identical to SEQ ID NO: 539556
  misc_feature: HIJSMM301D7Q2M.22.6.A06.1.454.light.4.raw

SEQ ID NO: 603258 - DNA, 487 bp, Homo sapiens
  misc_feature: HIJSMM301C2CHJ.48.53.E09.1.454.light.4.raw
agtatacatacacgaccggtgctcgatttagagagagtgtgttgggtttggggaagagctgctcagttaggacccagagggaaccatggaaaccccagcgcagcttctcttcctcctgctactctggctcccagataccaccggagcacttgtgttgacgcagtctccaggcaccctgtctttgtctccaggggagagagccaccctctcctgcagggccagtcagagtgttagcggcggctccgtagcctggtaccagcagaaacgtggccaggttcccaggctcctcatctatgatgcatccagcagggccactggcatcccagacaggttcagtggcagtgggtctggggcagacttcactctcaccatcagcagactggagcctgaagattttgcagtgtattactgtcagcagtatggtagctcacctcaactcactttcggcggagggaccaaggtggagatcaaacgaactgtggctgca

SEQ ID NO: 603259 - DNA, 518 bp, Homo sapiens; identical to SEQ ID NO: 539372
  misc_feature: HIJSMM301EIRHO.7.86.H09.1.454.light.4.raw

SEQ ID NO: 603260 - DNA, 502 bp, Homo sapiens; identical to SEQ ID NO: 559615
  misc_feature: HIJSMM301EQ85U.21.81.H04.1.454.light.4.raw

SEQ ID NO: 603261 - DNA, 480 bp, Homo sapiens
  misc_feature: HIJSMM301EDV1T.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaatggggtcccatcaaggttcagcggcagtggatctgggacagaattcactctcaccatcagcagcctacagcctgatgattttgcgacttattattgccaacagtataagagttattcaactttcggccctgggaccaatgtggatatcaaacgaactgtggctgcacatctgtt

SEQ ID NO: 603262 - DNA, 498 bp, Homo sapiens; identical to SEQ ID NO: 543340
  misc_feature: HIJSMM301CRDOH.16.78.H01.1.454.light.4.raw

SEQ ID NO: 603263 - DNA, 468 bp, Homo sapiens
  misc_feature: HIJSMM301BGKDL.18.59.F04.1.454.light.4.raw
tacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcacctcagcctccctggccatcactgggctccaggctgaggatgaggctgactattactgccagtcctatgacatgaggctggagtggttcgtatgtcttcggatctgggaccaaggtcaccgtcctaagtcagcccaaggccaacccctctgtcactctgttcccaccctcctccatactcgta

SEQ ID NO: 603264 - DNA, 506 bp, Homo sapiens
  misc_feature: HIJSMM301C3ATU.10.27.C05.1.454.light.4.raw
catagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgcctctttcaaggttttcggcggagggaccagactgaccgtcctaagtcagcccaaggctgccccctcggt

SEQ ID NO: 603265 - DNA, 478 bp, Homo sapiens; identical to SEQ ID NO: 535449
  misc_feature: HIJSMM301D8GR5.40.59.F04.1.454.light.4.raw

SEQ ID NO: 603266 - DNA, 441 bp, Homo sapiens; identical to SEQ ID NO: 534971
  misc_feature: HIJSMM301ESWLQ.11.3.A03.1.454.light.4.raw

SEQ ID NO: 603267 - DNA, 498 bp, Homo sapiens
  misc_feature: HIJSMM301AVS4S.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtgtaacattgtgatattcggcggagggaccaaggtgaccgtcctacgtcagcccaaggcctcgccccctcggtcactctcg

SEQ ID NO: 603268 - DNA, 444 bp, Homo sapiens; identical to SEQ ID NO: 535856
  misc_feature: HIJSMM301BBCWA.9.9.A09.1.454.light.4.raw

SEQ ID NO: 603269 - DNA, 350 bp, Homo sapiens; identical to SEQ ID NO: 537421
  misc_feature: HIJSMM301B5DGK.13.11.A11.1.454.light.4.raw

SEQ ID NO: 603270 - DNA, 505 bp, Homo sapiens
  misc_feature: HIJSMM301CZ7UB.49.30.C08.1.454.light.4.raw
agtcgagagacacgaccggtgctcgatttagtctgacgtcaaagggaaagggggaggaactgctcagttaggacccagagggaaccatggaagccccagctcagcttctcttcctcctgcttctctggctcccagatattaccggagaaattgtgttgacgcagtctccagccaccctgtctttgtctccaggggaaagagccaccctctcctgcagggccagtcagagtgttaacatctacttagtctggtaccaacagaaagctggccacgctcccaggctcctcatctatgatacatcctaccagggcccctggcatcccagccaggttcagtggcagtgggtctgggacagacttcactctcaccatcagcagcttagagcctgaagattttgcagtttattactgtcagcagcgtagcaatttgatcaccttcggccaagggacacgactggaaattaaacgaactgtggctgcaccatctgtcttcatcttcccgccta

SEQ ID NO: 603271 - DNA, 492 bp, Homo sapiens
  misc_feature: HIJSMM301CWL24.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggaccgttcggccgtacgggaccgacggtcggagtgtcgaagacgaactgtggtcgtgcaccat

SEQ ID NO: 603272 - DNA, 478 bp, Homo sapiens; identical to SEQ ID NO: 535129
  misc_feature: HIJSMM301DXXC6.11.11.A11.1.454.light.4.raw

SEQ ID NO: 603273 - DNA, 482 bp, Homo sapiens; identical to SEQ ID NO: 550464
  misc_feature: HIJSMM301EZ6F4.13.50.E06.1.454.light.4.raw

SEQ ID NO: 603274 - DNA, 361 bp, Homo sapiens; identical to SEQ ID NO: 544890
  misc_feature: HIJSMM301CFUOI.3.57.F02.1.454.light.4.raw

SEQ ID NO: 603275 - DNA, 549 bp, Homo sapiens
  misc_feature: HIJSMM301CVDIR.15.33.C11.1.454.light.4.raw
tctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcacaggcttacagaacgctcccctacccaacaacgcataagcgtcgctgccgcagcttcggtgcatggtttagccccgtttcatcttcccgccatctgagctacgt

SEQ ID NO: 603276 - DNA, 485 bp, Homo sapiens; identical to SEQ ID NO: 538954
  misc_feature: HIJSMM301A4AKB.3.55.E11.1.454.light.4.raw

SEQ ID NO: 603277 - DNA, 512 bp, Homo sapiens
  misc_feature: HIJSMM301EA6EN.47.55.E11.1.454.light.4.raw
agctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtccaccgtcctaggtcagcccaaggcccaacccctac

SEQ ID NO: 603278 - DNA, 493 bp, Homo sapiens
  misc_feature: HIJSMM301AVOO2.14.36.D03.1.454.light.4.raw
cgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaactcatgatttatgaggtcagtaatcggccctcaggggtttctaatcgcttctctggctccaagtctggcaacacggcctccctgaccatctctgggctccaggctgaggacgagtctgattattattgcagctcatatgcacctggcagcaatcatgtggttttcggcggggggtaccgaaggtgaccgtcctaggtcagccc

SEQ ID NO: 603279 - DNA, 520 bp, Homo sapiens
  misc_feature: HIJSMM301EB9WI.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggacaaaaacctggccaggctccccgactcctcttctttggtggagcctacagggccactggcaccccagacaggatcagtggcagcgggtctgggacagacttcattctcaccatcaaacagactgcagcctgaagatattgcagtttactactgtcagcagtatgttacgtccccgtggacgttcggccaagggaccaaggtggcaatcaaccgaactgtggctgcaccatctgtcttcatcttccccg

SEQ ID NO: 603280 - DNA, 496 bp, Homo sapiens; identical to SEQ ID NO: 536802
  misc_feature: HIJSMM301A4J7X.5.24.C02.1.454.light.4.raw

SEQ ID NO: 603281 - DNA, 485 bp, Homo sapiens
  misc_feature: HIJSMM301D8V0X.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaagaactgtggctgcaccat

SEQ ID NO: 603282 - DNA, 479 bp, Homo sapiens; identical to SEQ ID NO: 542895
  misc_feature: HIJSMM301E2CZT.40.59.F04.1.454.light.4.raw

SEQ ID NO: 603283 - DNA, 494 bp, Homo sapiens; identical to SEQ ID NO: 534992
  misc_feature: HIJSMM301EPZU7.9.1.A01.1.454.light.4.raw

SEQ ID NO: 603284 - DNA, 519 bp, Homo sapiens
  misc_feature: HIJSMM301AEKKZ.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactcgtggggtcccagacagattcagcggcagtgggtcaggcactgatttcacactggaaatcagcagggtggaggctgaggatggtttggggtttattactgcatgcaaactacacacggccgctctacttcggtcggacgggaccgaaggtggaggatacaaacgaactaggtggcgtcgcaccactctgtt

SEQ ID NO: 603285 - DNA, 505 bp, Homo sapiens; identical to SEQ ID NO: 555827
  misc_feature: HIJSMM301ECML5.13.11.A11.1.454.light.4.raw

SEQ ID NO: 603286 - DNA, 507 bp, Homo sapiens; identical to SEQ ID NO: 554434
  misc_feature: HIJSMM301BPBK1.8.28.C06.1.454.light.4.raw

SEQ ID NO: 603287 - DNA, 477 bp, Homo sapiens
  misc_feature: HIJSMM301DIROY.22.6.A06.1.454.light.4.raw
acatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgctttttggtatcaacagaggccaggccacgcccctgtcttaatgatatataaagacagtgagaggccctcagggatctctgagcgattctctgcctccagctcagggacaacattcacattgaccatcagtgaagtccaggcagaagatgaggctgactattatgtcaatcaacagacagtagtgggaaatatgtggtattcgggcggagggaccaaactgaccgtcctaggtcagcccaaggct

SEQ ID NO: 603288 - DNA, 501 bp, Homo sapiens; identical to SEQ ID NO: 548357
  misc_feature: HIJSMM301EW12O.19.67.G01.1.454.light.4.raw

SEQ ID NO: 603289 - DNA, 499 bp, Homo sapiens
  misc_feature: HIJSMM301CL0RD.40.54.E10.1.454.light.4.raw
tctagcgactcacgaccggtgctcgatttagatcgtagcagaacacaccaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccagcatcacctgctctggagattcattgtcaaaagcaatatgcttattggtaccagcagaaaccaggccaggcccctgtggtggtgctatataaagacactgagaggccctcagggacccctgagcgattctctggctccaggtcagggacaacagtcacgttgaccatcagtggagtccaggcagaagacgaggctgactattactgtcaatcagcagacagcagtggtacttttcgggttttcggcggagggaccaagctgaccgtcctaggtcagcccaaggctgccccctcggt

SEQ ID NO: 603290 - DNA, 494 bp, Homo sapiens; identical to SEQ ID NO: 534994
  misc_feature: HIJSMM301EMYI3.27.78.H01.1.454.light.4.raw

SEQ ID NO: 603291 - DNA, 496 bp, Homo sapiens; identical to SEQ ID NO: 535109
  misc_feature: HIJSMM301D9FNJ.16.78.H01.1.454.light.4.raw

SEQ ID NO: 603292 - DNA, 510 bp, Homo sapiens; identical to SEQ ID NO: 542037
  misc_feature: HIJSMM301EBE97.4.57.F02.1.454.light.4.raw

SEQ ID NO: 603293 - DNA, 491 bp, Homo sapiens; identical to SEQ ID NO: 535294
  misc_feature: HIJSMM301AUFE4.16.68.G02.1.454.light.4.raw

SEQ ID NO: 603294 - DNA, 490 bp, Homo sapiens
  misc_feature: HIJSMM301EA8FS.9.34.D01.1.454.light.4.raw
tgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggaacagcccccaaagtcatcatttatgacaacatgaagcggccctcagggtccctgaccgattctccggctccaagtctggcacatcagccctccctggccatcactgggctccaggctgaggatgaggctgactattactgccagtcgtatgacagtggcctaagtaacatcgtctcggactgggaccaaggtcacgtccg

SEQ ID NO: 603295 - DNA, 481 bp, Homo sapiens
  misc_feature: HIJSMM301BGGDY.49.50.E06.1.454.light.4.raw
agtcgagagacacgaccggtgctcgatttagatctactgacaacacacaaggggagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactatttaaattggtatcagcagaaaccagggaaagcccctaaactcctgatctacgatgcatccaatttggagacaggggtcccatcaaggttcagtggaagtggatctgggacacattttactttcaccatcagcggcctgcagcctgaagattttgcaacatattactgtcaacagtatgaagatctcccactcactttcggcggagggaccaaggtggagatcagacgaactgtggctgcaccatt

SEQ ID NO: 603296 - DNA, 509 bp, Homo sapiens
  misc_feature: HIJSMM301B2CV1.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggtcttttcggcggagggaccaagctgaccgtcctgggtcacgcccaaggcctcgccccctcggtcta

SEQ ID NO: 603297 - DNA, 509 bp, Homo sapiens; identical to SEQ ID NO: 549778
  misc_feature: HIJSMM301DJ0XZ.17.33.C11.1.454.light.4.raw

SEQ ID NO: 603298 - DNA, 484 bp, Homo sapiens; identical to SEQ ID NO: 535400
  misc_feature: HIJSMM301DNAJV.46.26.C04.1.454.light.4.raw

SEQ ID NO: 603299 - DNA, 480 bp, Homo sapiens
  misc_feature: HIJSMM301COGX9.40.23.C01.1.454.light.4.raw
tctagcgactcacgaccggtgctcgatttagtacacgtgattagggattgggggggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagcccaaggc

SEQ ID NO: 603300 - DNA, 506 bp, Homo sapiens; identical to SEQ ID NO: 554189
  misc_feature: HIJSMM301AOL8X.19.78.H01.1.454.light.4.raw

SEQ ID NO: 603301 - DNA, 497 bp, Homo sapiens; identical to SEQ ID NO: 536376
  misc_feature: HIJSMM301C53NO.22.9.A09.1.454.light.4.raw

SEQ ID NO: 603302 - DNA, 511 bp, Homo sapiens; identical to SEQ ID NO: 577883
  misc_feature: HIJSMM301EMCTC.17.33.C11.1.454.light.4.raw

SEQ ID NO: 603303 - DNA, 489 bp, Homo sapiens
  misc_feature: HIJSMM301A8NV8.52.82.H05.1.454.light.4.raw
cgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggacactgagaggccctcagggatccctgagcgattctctggctccacctcagggacactagtcacgttgaccatcagtggagtccaggcagaggacgaggctgactaccactgtcaatcaacagacagcagtggttcttatgtcttcgcaactgggaccaaggtcaccgtctaggtcagcccaagccaacccactgtcact

SEQ ID NO: 603304 - DNA, 513 bp, Homo sapiens; identical to SEQ ID NO: 535244
  misc_feature: HIJSMM301A9I80.17.33.C11.1.454.light.4.raw

SEQ ID NO: 603305 - DNA, 462 bp, Homo sapiens; identical to SEQ ID NO: 537922
  misc_feature: HIJSMM301EP1ES.10.9.A09.1.454.light.4.raw

SEQ ID NO: 603306 - DNA, 502 bp, Homo sapiens
  misc_feature: HIJSMM301CTE25.48.83.H06.1.454.light.4.raw
agtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcggggggaccgaggctgaccgtcggcggtcgagcccaaggctgccccctcggtcactctgttcccg

SEQ ID NO: 603307 - DNA, 506 bp, Homo sapiens; identical to SEQ ID NO: 555851
  misc_feature: HIJSMM301D64AV.19.78.H01.1.454.light.4.raw

SEQ ID NO: 603308 - DNA, 503 bp, Homo sapiens
  misc_feature: HIJSMM301ESL7I.9.67.G01.1.454.light.4.raw
tgatacgtctcacgaccggtgctcgatttagagtatacatattgggtttggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccactggtatcccggccaggttcagtggtagtgggtctgggacagagttcgttctcaccatcagcagcctgcagtctgaagattttgaagtttattactgtcagcactataatagttggccgctcactttcggcggagggaccaaggtggagctcaaacgaactgtggctgcaccatctgtcttcatcttccccg

SEQ ID NO: 603309 - DNA, 485 bp, Homo sapiens; identical to SEQ ID NO: 543370
  misc_feature: HIJSMM301C322U.3.10.A10.1.454.light.4.raw

SEQ ID NO: 603310 - DNA, 530 bp, Homo sapiens
  misc_feature: HIJSMM301CV8RM.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggcctccagcctgaggacgaggctgattattattgttagttcatatacaaccagtgacacgttgggtggttcggcggagggaccgaggctgaccgtccgtaggtcacgcccaaggcctcgccccctcggcactctcgttcccgccct

SEQ ID NO: 603311 - DNA, 482 bp, Homo sapiens; identical to SEQ ID NO: 541033
  misc_feature: HIJSMM301CVFXK.4.27.C05.1.454.light.4.raw

SEQ ID NO: 603312 - DNA, 512 bp, Homo sapiens
  misc_feature: HIJSMM301DP6UC.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgctagtttattactgtcaacatcgtaccgagtggccgtccgggggccacgtttcggccctcgggaccaaagtggatatcaaacgaactgtggctgcaccatctgtcttcta

SEQ ID NO: 603313 - DNA, 499 bp, Homo sapiens
  misc_feature: HIJSMM301DEWXU.9.53.E09.1.454.light.4.raw
tgatacgtctcacgaccggtgctcgatttagagagagtgtgttgggtttgggggctggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaagggtgaccgtcctaggtcagcccaaggc

SEQ ID NO: 603314 - DNA, 509 bp, Homo sapiens; identical to SEQ ID NO: 536339
  misc_feature: HIJSMM301AX31K.17.33.C11.1.454.light.4.raw

SEQ ID NO: 603315 - DNA, 505 bp, Homo sapiens; identical to SEQ ID NO: 547532
  misc_feature: HIJSMM301BCAH1.8.1.A01.1.454.light.4.raw

SEQ ID NO: 603316 - DNA, 444 bp, Homo sapiens; identical to SEQ ID NO: 534993
  misc_feature: HIJSMM301BEX86.5.9.A09.1.454.light.4.raw

SEQ ID NO: 603317 - DNA, 486 bp, Homo sapiens; identical to SEQ ID NO: 536323
  misc_feature: HIJSMM301DHMOM.10.2.A02.1.454.light.4.raw

SEQ ID NO: 603318 - DNA, 467 bp, Homo sapiens
  misc_feature: HIJSMM301A8L8D.51.53.E09.1.454.light.4.raw
cgatcgtatacacgaccggtgctcgatttagagagagtgtgttgggtttgggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaaccagggacagcccctaaactcctgatcctcgatgcatccactttggaaacagggtcccatcaaggttcagtggaagtggctctgggacagattttactttcaccatcagcaggctgcagcctgaagacattgcaacatattactgtcaacagtatgatagtctcccgctcactttcggcgggggaccaaggtgagatcaagcgaa

SEQ ID NO: 603319 - DNA, 494 bp, Homo sapiens; identical to SEQ ID NO: 534994
  misc_feature: HIJSMM301AEKEO.27.78.H01.1.454.light.4.raw

SEQ ID NO: 603320 - DNA, 475 bp, Homo sapiens
  misc_feature: HIJSMM301EPUMB.52.1.A01.1.454.light.4.raw
cgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggttcagtggcagtggatctgggacagaattcactctcaccatcaccagtctgcaggctgaggattttgcaacttacttctgtcaacagagttacagttccctcacctttcggccctgggaccatagtggatatcaaacgaactgtggctgcaccatctgtcttcatctcccgccat

SEQ ID NO: 603321 - DNA, 498 bp, Homo sapiens
  misc_feature: HIJSMM301DM69O.27.78.H01.1.454.light.4.raw
  modified_base (386)..(386): a, c, t, g, unknown or other
  modified_base (463)..(463): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagntgctgcaacttattactgtcatcagagtactactttacctcaagtgatcaccttcggaccaagggacacgactgganaattaaacgaactggtcggctgcaccatctgtctt

SEQ ID NO: 603322 - DNA, 360 bp, Homo sapiens
  misc_feature: HIJSMM301EWF3D.14.88.H11.1.454.light.4.raw
cgtctagtaccacgaccggtgctcgatttagcgacagcgagaacacacaaaggggacgttggtggttatgaccttgtctcctggtaccaacagcacccaggcaaagcccccaaactcataatttatgaggtcagtaggcggccgtcaggggtccctgatcgcttctctggctccaagtttggcaacacggcctccctgaccgtctctgggctccaggctgaggatgaggctgattattattgcatctcatatgcaggccctaatcattatggcctcggaactgggaccgaggtcaccgtcctgggtcagcccaaggccaaccccactgtcactctgttcccaccctcctcgtactagacg

SEQ ID NO: 603323 - DNA, 512 bp, Homo sapiens; identical to SEQ ID NO: 542831
  misc_feature: HIJSMM301D0WE7.43.19.B08.1.454.light.4.raw

SEQ ID NO: 603324 - DNA, 442 bp, Homo sapiens; identical to SEQ ID NO: 569490
  misc_feature: HIJSMM301D85QO.11.3.A03.1.454.light.4.raw

SEQ ID NO: 603325 - DNA, 496 bp, Homo sapiens; identical to SEQ ID NO: 537925
  misc_feature: HIJSMM301C9IZF.22.14.B03.1.454.light.4.raw

SEQ ID NO: 603326 - DNA, 511 bp, Homo sapiens
  misc_feature: HIJSMM301EUMF8.43.67.G01.1.454.light.4.raw
tgtgagtagtcacgaccggtgctcgatttagagtatacatattgggtttgggggctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggccggggaccgaccgtggaaatacaaacgaactagtggctgcaccatctgtcttcta

SEQ ID NO: 603327 - DNA, 485 bp, Homo sapiens; identical to SEQ ID NO: 536576
  misc_feature: HIJSMM301CCCCZ.46.35.D02.1.454.light.4.raw

SEQ ID NO: 603328 - DNA, 484 bp, Homo sapiens; identical to SEQ ID NO: 550343
  misc_feature: HIJSMM301CUNVY.40.81.H04.1.454.light.4.raw

SEQ ID NO: 603329 - DNA, 486 bp, Homo sapiens
  misc_feature: HIJSMM301A7A79.52.32.C10.1.454.light.4.raw
cgcagtacgacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacgaagtcaccatgacttgccgggcaagtcagagcattagcagccatttgaattggtatcagcagaaacctgggaaagcccctcagctcctgatctttgctgcatccagtttgcacagtggggtcccatcaaggttcagtggcagtggatctgggacagacttcactctcaccatcagcagtctgcaacctgaggattttgccacttactactgtcaacagacttaactaataaccctccacctacacgtttacgttcacgggaccggaacgaacgtgaggatcagaaccg

SEQ ID NO: 603330 - DNA, 501 bp, Homo sapiens
  misc_feature: HIJSMM301APNI5.19.67.G01.1.454.light.4.raw
tactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcagcccactctgtgtcggagtctccggggaagacggtaaccatctttgcacccacaacagtggcaacattgccagcaattttgtgcagtggtaccagcagcgcccgggcagttcccccaccattgtgatctatgaggataatcaaagaccgtctggggtccctgatcggttctctggctccatcgacagctcctccaactctgcctccctcaccatctctggactgaagactgaggacgaggctgactactactgtcagtcttatgatagccgcggtcatgtggtcttcggcggagggaccaaggctgaccgtcctaggtcagcccaaggctgccccctc

SEQ ID NO: 603331 - DNA, 496 bp, Homo sapiens
  misc_feature: HIJSMM301CIN4B.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccagggtggaaatcaaacgaactgtaggctgcaccatctgtcttcatt

SEQ ID NO: 603332 - DNA, 501 bp, Homo sapiens
  misc_feature: HIJSMM301B6RU3.40.67.G01.1.454.light.4.raw
tctagcgactcacgaccggtgctcgatttagagtatacatattgggtttggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcaggtgggtctgggacagacttcactctcaccatcagcggcctagagcctgaagacttttgctagttttattactgtcagcagcgtaccaactggccgctcactttcggcggagggaccaaggtggagatacaaacgaactgtggctgcaccatctgtcttcatt

SEQ ID NO: 603333 - DNA, 441 bp, Homo sapiens; identical to SEQ ID NO: 546257
  misc_feature: HIJSMM301D668Y.41.9.A09.1.454.light.4.raw

SEQ ID NO: 603334 - DNA, 511 bp, Homo sapiens
  misc_feature: HIJSMM301DZVHG.5.58.F03.1.454.light.4.raw
atcagacacgcacgaccggtgctcgatttagtctgatcgagaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgattttactgctgctcatatgcaggtgatcacacttttatgttcgggactgggaccaaggtcaccgtcctaggtcagcccaaggccaaccccactgtcactctcg

SEQ ID NO: 603335 - DNA, 504 bp, Homo sapiens; identical to SEQ ID NO: 545187
  misc_feature: HIJSMM301D3U0C.5.68.G02.1.454.light.4.raw

SEQ ID NO: 603336 - DNA, 493 bp, Homo sapiens; identical to SEQ ID NO: 549574
  misc_feature: HIJSMM301DRO57.16.53.E09.1.454.light.4.raw

SEQ ID NO: 603337 - DNA, 517 bp, Homo sapiens
  misc_feature: HIJSMM301C9VCY.48.14.B03.1.454.light.4.raw
agtatacatacacgaccggtgctcgatttagtgtgagtagttccgcggggatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccaagggacccgggtggaaataaaacgaactagtggctgcaccatctgtcttcactcttccccg

SEQ ID NO: 603338 - DNA, 483 bp, Homo sapiens; identical to SEQ ID NO: 547838
  misc_feature: HIJSMM301DIZF7.46.26.C04.1.454.light.4.raw

SEQ ID NO: 603339 - DNA, 496 bp, Homo sapiens
  misc_feature: HIJSMM301AQTYQ.40.57.F02.1.454.light.4.raw
  modified_base (332)..(332): a, c, t, g, unknown or other
tctagcgactcacgaccggtgctcgatttagctcgatatagttgggtttgggggctggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcnctgatcgcttctctggctccaagtctggcgacacggcctccctgaccatctctgggctccagactgaggatgaggctacttatttttgctgctcttatgcaggcagtttcgctctcgaagtgttcggcggagggaccgagctgaccgtcctacgtcagcccaac

SEQ ID NO: 603340 - DNA, 502 bp, Homo sapiens; identical to SEQ ID NO: 541971
  misc_feature: HIJSMM301B4ULI.4.39.D06.1.454.light.4.raw

SEQ ID NO: 603341 - DNA, 504 bp, Homo sapiens; identical to SEQ ID NO: 538940
  misc_feature: HIJSMM301D7BGF.2.35.D02.1.454.light.4.raw

SEQ ID NO: 603342 - DNA, 508 bp, Homo sapiens
  misc_feature: HIJSMM301B60QA.11.57.F02.1.454.light.4.raw
  modified_base (490)..(490): a, c, t, g, unknown or other
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatntgtcttcatcttcccgcc

SEQ ID NO: 603343 - DNA, 505 bp, Homo sapiens; identical to SEQ ID NO: 542781
  misc_feature: HIJSMM301CFDMJ.4.57.F02.1.454.light.4.raw

SEQ ID NO: 603344 - DNA, 522 bp, Homo sapiens
  misc_feature: HIJSMM301EKKUO.10.86.H09.1.454.light.4.raw
catagtagtgcacgaccggtgctcgatttagtgctatagacttgggtttggggagctctgcttcagctgtgagcgcagaaggcgggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggcttttcggcggagggactaagttgaccgtcctacgtcagcccaaggctgccccctcggtcta

SEQ ID NO: 603345 - DNA, 514 bp, Homo sapiens; identical to SEQ ID NO: 546238
  misc_feature: HIJSMM301BEH6S.47.85.H08.1.454.light.4.raw

SEQ ID NO: 603346 - DNA, 504 bp, Homo sapiens
  misc_feature: HIJSMM301C1I5W.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagctagtatggtcaccgtacccaagtaactttcggaccgacggggaccgaagcgtggagatacaaacgtaacgtgtggctgcacctatcttcg

SEQ ID NO: 603347 - DNA, 489 bp, Homo sapiens
  misc_feature: HIJSMM301B0GE7.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttacagggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgaactgt

SEQ ID NO: 603348 - DNA, 501 bp, Homo sapiens
  misc_feature: HIJSMM301CDYER.14.36.D03.1.454.light.4.raw
cgtctagtaccacgaccggtgctcgatttagctgcgtcacgatctctcttggggggggtcgtcaggaggcagctctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaactcatgatttatgaggtcagtaatcggccctcaggggtttctaatcgcttctctggctccaagtctggcaacacggcctccctgaccatctctgggctccaggctgaggacgagtctgattattattgcagctcatatgcacctggcagcaatcatgtgggttttcggcggggggaccaaggtgaccgtcctaggtcacgcccaacggcg

SEQ ID NO: 603349 - DNA, 509 bp, Homo sapiens
  misc_feature: HIJSMM301EICPL.48.87.H10.1.454.light.4.raw
agtatacatacacgaccggtgctcgatttagcagtactgcgttgggtttgggggctgtcaaactgattaggaactgacttccacctgcaggtcagggccaaggttatggggtcccaggttcacctcctcagcttcctcctcctttggatctctgataccagggcagaaacgacactcacgcagtctccagcattcatgtcagcgactccaggagacaaagtcaacatctcctgcaaaggcagccaagactttgatggtgatatgaactggtaccaacacagaccaggagaagctgctattttcattattcaagaggctactactctcgttcctggaatcgcacctcgattccgtggcagcggatttggaacagattttaccctcacaattaaaaacatagaatgtgaggatgctgcatattacttctgtctgcaatatgataagtcccccctacgtggacgttcggccaagggaccaaggtggaaatcaaacgaactagtggctgcacc

SEQ ID NO: 603350 - DNA, 521 bp, Homo sapiens
  misc_feature: HIJSMM301B6ZFY.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggggcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctcgttcccgccctcctcctacg

SEQ ID NO: 603351 - DNA, 485 bp, Homo sapiens; identical to SEQ ID NO: 535606
  misc_feature: HIJSMM301D1I8Q.47.46.E02.1.454.light.4.raw

SEQ ID NO: 603352 - DNA, 491 bp, Homo sapiens; identical to SEQ ID NO: 549507
  misc_feature: HIJSMM301AF47W.5.57.F02.1.454.light.4.raw

SEQ ID NO: 603353 - DNA, 500 bp, Homo sapiens
  misc_feature: HIJSMM301AXQNP.19.78.H01.1.454.light.4.raw
tactctcgtgcacgaccggtgctcgatttagtgtgagtagtttgggtttgggggctttatttgggctctgctgctcctcactctactcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtattctcttatgtcttcggaactgggaccaaggtcaccgtcctaggtcagcccaaggccaaccccactgtcactctgttcccaccctcctccacgagagta

SEQ ID NO: 603354 - DNA, 502 bp, Homo sapiens
  misc_feature: HIJSMM301AH3AB.12.12.B01.1.454.light.4.raw
atacgacgtacacgaccggtgctcgatttagtagtgtagattccgcggggacagcgaccatgttctgagggtcagactcaaacagcatcacccaggacaccgacaggagccggggcacaatgagagcctcacctgggaaatgcagccggaggcacctgggcccagatgtcagcctgggcagctcccacagtgctggaattccctggaagatgccccaaggttgagtctctgaggcctcctatgagctgacacagccaccctcggtgtcagtgtcccccaggacaaacggccaggatcacctgctctggagctgcattgccaataaaatctccttattggtaccagcagaagtcaggccaggcccctgtattggtcatctatgaggacaacagacgaccttccgggatccctcgagagattctctggctccacctcagggacaaatggccaccttgactatacagtggcgcccgacggtgggaggagtgtaggcgtcgactaa

SEQ ID NO: 603355 - DNA, 416 bp, Homo sapiens; identical to SEQ ID NO: 539343
  misc_feature: HIJSMM301C65OR.18.78.H01.1.454.light.4.raw

SEQ ID NO: 603356 - DNA, 545 bp, Homo sapiens
  misc_feature: HIJSMM301B9GCE.17.25.C03.1.454.light.4.raw
cgtagactagcacgaccggtgctcgatttagtagtgtagatttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcacaggcttacagaacgctcccctacccaacaacgcataagcgtcgctgccgcagcttcggtgcatggtttagccccgcttcatcttcccgccatctgact

SEQ ID NO: 603357 - DNA, 510 bp, Homo sapiens
  misc_feature: HIJSMM301A33XT.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaaccccactcgtcactctgttcccg

SEQ ID NO: 603358 - DNA, 483 bp, Homo sapiens; identical to SEQ ID NO: 557245
  misc_feature: HIJSMM301DXRBV.46.35.D02.1.454.light.4.raw

SEQ ID NO: 603359 - DNA, 521 bp, Homo sapiens
  misc_feature: HIJSMM301C2CWW.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccgaacggaccgaacggtaggaaggtacaaacgaacgtagtggcgtgcaccatctgttcttctacttcttcccgtcccact

SEQ ID NO: 603360 - DNA, 496 bp, Homo sapiens
  misc_feature: HIJSMM301CQ2O7.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcagcagtataataactggttcctgctcactttcgggcgggggaccgaaggtggagagtcaaacgaactgtggctgcaccatctgtt

SEQ ID NO: 603361 - DNA, 497 bp, Homo sapiens; identical to SEQ ID NO: 571644
  misc_feature: HIJSMM301DEXJ7.41.53.E09.1.454.light.4.raw

SEQ ID NO: 603362 - DNA, 502 bp, Homo sapiens
  misc_feature: HIJSMM301BWRUG.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatacttattcggcggagggaccaagctgaccgtcctgcgtcagcccaaggctgccccctcggtcact

SEQ ID NO: 603363 - DNA, 485 bp, Homo sapiens; identical to SEQ ID NO: 536040
  misc_feature: HIJSMM301AW663.15.1.A01.1.454.light.4.raw

SEQ ID NO: 603364 - DNA, 503 bp, Homo sapiens; identical to SEQ ID NO: 535044
  misc_feature: HIJSMM301BEG7J.19.78.H01.1.454.light.4.raw

SEQ ID NO: 603365 - DNA, 499 bp, Homo sapiens
  misc_feature: HIJSMM301D3QMH.43.34.D01.1.454.light.4.raw
tgtgagtagtcacgaccggtgctcgatttagatcgtctgtgttgggtttggggagcttcagctgtgggtagagaagacaggactcaggacaatctccagcatggccagcttccctctcctcctcaccctcctcactcactgtgcagggtcctgggcccagtctgtggtgactcagccaccctcagcgtctgggacccccggacagagggtcagcatctcctgttctggaagcagctccaacattggacgtaatactgtaaactggtaccagcaactcgcaggaacggcccccaaactcctcatctatgaccatcatcagcggccctcaggggtccctgaccgattctctggctccaagtctggctcttcagcctccctggccatcagtgggctccagtctgaggatgaggctgattattactgtgcagcgtgggatgacagcctgaatgcttgggtgttcggcggagggaccaaggtgaccgtcctaggtcagaccccg

SEQ ID NO: 603366 - DNA, 497 bp, Homo sapiens
  misc_feature: HIJSMM301AVBQQ.3.10.A10.1.454.light.4.raw
agacgcactccacgaccggtgctcgatttagcgtcgatctcagggggaggaactgctcagttaggacccagacggaaccatggaagccccagcgcagcttctcttcctcctgctactctggctcccagatgccactggagaaatagtgatggcgcagtctccagccaccctgtctgtgtctccaggggaaagagccaccctctcctgcagggccagtcagtctgtttataacaacttagcctggtaccaacagagacctggccaggctcccaggctcctcatgtttggtgcttccaccagggccactggtatcccagccaggttcagtggcagtgggtctgggacagagttcactctcaccatcagcagcctgcagtctgaagattttgcaatttatttctgtcagcagtacaataattggcctttgacgttcggccaagggaccaaggtggaaactaaacgaactgtggctgcaccatctgtcttcatttcccgcc

SEQ ID NO: 603367 - DNA, 503 bp, Homo sapiens; identical to SEQ ID NO: 555460
  misc_feature: HIJSMM301EMWM5.8.42.D09.1.454.light.4.raw

SEQ ID NO: 603368 - DNA, 510 bp, Homo sapiens
  misc_feature: HIJSMM301B7PNA.5.59.F04.1.454.light.4.raw
atcagacacgcacgaccggtgctcgatttagtacacacacttagggattgggggagctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcgaaacctggccaggttcccagcctcctcatctatggtatatccaccagggccactggcatcccagacaggttcagtggcagcgggtctgggacagacttcgctctcaccatcagcagactggagcctgaagattttgcagtgtattactgtcagcagtatggtagctcacggacgttcggccgaagggaccgaacggtggaaagtacaaacgaactagtggctgcaccatctgtcttcatcttcccgtccta

SEQ ID NO: 603369 - DNA, 494 bp, Homo sapiens; identical to SEQ ID NO: 598786
  misc_feature: HIJSMM301BNTPZ.16.86.H09.1.454.light.4.raw

SEQ ID NO: 603370 - DNA, 517 bp, Homo sapiens
  misc_feature: HIJSMM301D93J8.43.59.F04.1.454.light.4.raw
tgtgagtagtcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgaccatctctgggctccaggctgaggacgaggctgattattactgcaactcacttacaacgaccgacacttgcgtattcggcggcgggaccaagctgaccgtctaggtcagcccaaggctgccccctcggtcactctgttccccg

SEQ ID NO: 603371 - DNA, 506 bp, Homo sapiens
  misc_feature: HIJSMM301D5AI2.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgttcttcggaactgggaccaaggtcaccgtcctaggtcagcccaaggccaaccccactgtca

SEQ ID NO: 603372 - DNA, 497 bp, Homo sapiens
  misc_feature: HIJSMM301BXG6S.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtacaacagacttacagtccgccccccgactccaccttcggccaacgggacacgactaggagaattaaacgaactgtttggctgcaccatctgtcttc

SEQ ID NO: 603373 - DNA, 514 bp, Homo sapiens
  misc_feature: HIJSMM301CY23I.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttatactgtcaacagttttctcgggtcgttcggccgtaacgggaccgaaaggtcggaaagtcaaaacgaaacctagtggctggcaccatctgtcttcatcttccccg

SEQ ID NO: 603374 - DNA, 496 bp, Homo sapiens; identical to SEQ ID NO: 565908
  misc_feature: HIJSMM301E1H5R.26.72.G06.1.454.light.4.raw

SEQ ID NO: 603375 - DNA, 504 bp, Homo sapiens
  misc_feature: HIJSMM301EBAW4.9.12.B01.1.454.light.4.raw
  modified_base (429)..(429): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttcncgggcgttcggccaaggaccaaggtggaaatacaaacgaactagtggctgcaccatctgtcttctatcttccccg

SEQ ID NO: 603376 - DNA, 499 bp, Homo sapiens
  misc_feature: HIJSMM301C2KDJ.15.56.F01.1.454.light.4.raw
tctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaactcatgatttatgaggacaatgagcggccctcaggggtttctaatcgcttctctggctccaagtctgacaacacggcctccctgacaatctctgggctccaggctgaggacgagggtgattattactgctgcgcatatagaagtcccactgttgtacttttcggcggagggaccaagctgaccgtcctaggtcagcccaaggctgccccctcggtcactctgttcccaccctcctgctacgtga

SEQ ID NO: 603377 - DNA, 463 bp, Homo sapiens; identical to SEQ ID NO: 535008
  misc_feature: HIJSMM301AXOIJ.10.9.A09.1.454.light.4.raw

SEQ ID NO: 603378 - DNA, 497 bp, Homo sapiens
  misc_feature: HIJSMM301BPQI3.49.80.H03.1.454.light.4.raw
agtcgagagacacgaccggtgctcgatttagctgtgcgtcgaagggaaagggggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggcccaaccccactgtcactctgttcccaccct

SEQ ID NO: 603379 - DNA, 508 bp, Homo sapiens; identical to SEQ ID NO: 552440
  misc_feature: HIJSMM301DQMRJ.5.24.C02.1.454.light.4.raw

SEQ ID NO: 603380 - DNA, 487 bp, Homo sapiens
  misc_feature: HIJSMM301B3GQE.5.40.D07.1.454.light.4.raw
atcagacacgcacgaccggtgctcgatttagtgatagagcgtaacaacagaggggggaactgctcagttaggacccagacggaaccatggaagccccagcgcagcttctcttcctcctgctactctggctcccagataccattggagagatagtgatgacgcagtctccagccaccctgtctgtgtctccaggggaaagagccaccctctcctgcagggccagccagagtgtaagtagtaggttagcctggtatcagcagaaacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcaacagtataatgactggtggacgttcggccaagggaccaaggtggagaccaacgaactgtggctgcaccatctgtt

SEQ ID NO: 603381 - DNA, 512 bp, Homo sapiens; identical to SEQ ID NO: 562621
  misc_feature: HIJSMM301D6OD3.7.34.D01.1.454.light.4.raw

SEQ ID NO: 603382 - DNA, 514 bp, Homo sapiens; identical to SEQ ID NO: 577697
  misc_feature: HIJSMM301BKK7K.14.7.A07.1.454.light.4.raw

SEQ ID NO: 603383 - DNA, 511 bp, Homo sapiens
  misc_feature: HIJSMM301BIP63.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttatactgtcaacagttttctcgggcgttcggccgaacgggaccgaaggtaggaaagtacaaacgaactagtggcgtgcaccatctgtcttctactcttccccg

SEQ ID NO: 603384 - DNA, 521 bp, Homo sapiens
  misc_feature: HIJSMM301BZSCK.41.78.H01.1.454.light.4.raw
  modified_base (511)..(511): a, c, t, g, unknown or other
tctatactatcacgaccggtgctcgatttagtgtgagtagtttgggtttgggggggcctaaggaagcagcactggtggtgcctcagccatggcctggaccgttctcctcctcggcctcctctctcactgcacagcctctgtgacctcctatgtgttgactcagccaccctcggcgtcagtggccctaggacagacggccaggattacctgtggggcaaataagataggaactacaaatgtgcactggtaccaacagaggccaggccaggcccctgtggtggtcgtccatgatgattacgaccggccctcaggaatccctgagcgattctctggctccaattctgggaacacggccaccctgaccatcaccggggtcgaggccggggatgaggccacctactattgtcacgtctgggagactggtgatgatcctgtggcgctattcggcggagggacgaagctgaccgtcctgggtcagcccaaggctgccccctcggtcactctgttcccnccctcctcat

SEQ ID NO: 603385 - DNA, 503 bp, Homo sapiens
  misc_feature: HIJSMM301DSKWK.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtctaggtcagcccaaggccaaccccatgtca

SEQ ID NO: 603386 - DNA, 490 bp, Homo sapiens
  misc_feature: HIJSMM301DAOK9.14.55.E11.1.454.light.4.raw
  modified_base (384)..(384): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagnttttgcaacttactactgtcaacagagttacacgtacccccctcactttcggcggagggaccaaggcggagatcagacgaactgtggctgcaccatctgtcttcta

SEQ ID NO: 603387 - DNA, 490 bp, Homo sapiens
  misc_feature: HIJSMM301CSZOW.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatgtcacgtcccaagaacttttggccagggaccaagctggagatcaaacgaactgtggctgcgaccatcttcg

SEQ ID NO: 603388 - DNA, 496 bp, Homo sapiens
  misc_feature: HIJSMM301BBJV1.22.9.A09.1.454.light.4.raw
acatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtgggtctggaagagacttcactctaaccatcaacagcctagagcctgacgattctgcagtttattactgtcagcagcgtaccaagtggcctccgactttggcctaggggccaagcctggagatcagacgaactgtggctgcaccatctgtcttcatcttcccg

SEQ ID NO: 603389 - DNA, 501 bp, Homo sapiens; identical to SEQ ID NO: 569393
  misc_feature: HIJSMM301A8HDU.16.86.H09.1.454.light.4.raw

SEQ ID NO: 603390 - DNA, 495 bp, Homo sapiens; identical to SEQ ID NO: 542416
  misc_feature: HIJSMM301EJX9L.27.78.H01.1.454.light.4.raw

SEQ ID NO: 603391 - DNA, 485 bp, Homo sapiens
  misc_feature: HIJSMM301DZPUJ.4.41.D08.1.454.light.4.raw
agcactgtagcacgaccggtgctcgatttagtcacgcgagaaaggggaaagggggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagcctgggcgagcccctaaactcctgatctatggtgcatcaagtctgcaaagtggggtcccatcgaggttcagaggcagtggatctgggacagatttcactctcaccatcagcggcctgcagcctgaagattatgcaacttactattgtcagagttctaattctttcccgcgcacgtttggccaggggaccaaggtagagatcaaacgaactgtggctgcaccat

SEQ ID NO: 603392 - DNA, 500 bp, Homo sapiens
  misc_feature: HIJSMM301BA26V.52.35.D02.1.454.light.4.raw
cgcagtacgacacgaccggtgctcgatttagcacacgatagttgggtttgggggaggaactgctcagttaggacccagagggaaccatggaagccccagctcagcttctcttcctcctgctactctggctcccagataccaccggagaagttgtattgacacagtctccagccaccctgtctttgtctccaggggggagagccaccctctcctgcagggccagtcagagtgttggcaacctcttagcctggtaccaacaaaacctggccaggctcccaggctcctcatctatgatgcatccacgagggccactggcatcccagccaggttcagtggcagtgggtctgagacagacttcactctcaccatcagtggcctcgagcctgaagattttgcagtttattactgtcagcagcgtagccactggctctctttcggcggagggaccaaggttgagatcaaacgaactgtggctgcaccatctgtcttcatcttccccg

SEQ ID NO: 603393 - DNA, 504 bp, Homo sapiens; identical to SEQ ID NO: 556255
  misc_feature: HIJSMM301BM061.48.26.C04.1.454.light.4.raw

SEQ ID NO: 603394 - DNA, 479 bp, Homo sapiens
  misc_feature: HIJSMM301DXD3G.5.12.B01.1.454.light.4.raw
  modified_base (461)..(461): a, c, t, g, unknown or other
atcagacacgcacgaccggtgctcgatttagtagtgtagattccgcgggggcccactgttagggctcaggggctgtgtccaccatggcctggactcttctccttctcgtgctcctctctcactgcacaggttccctctcccagcctgtgctgactcagccatcttcccattctgcatcttctggagcatcagtcagactcacctgcatgctgagcagtggcttcagtgttggggacttctggataaggatatcagaggctgattgcagagtcaccttatagatcacttcatagacacagggaacagaagacacagacaactgaggaagcaaagtttaaattctactcacgtttgatttccaccttggtcccttggccgaacgtcctcgggtgttcggcggagggaccaagctgaccgtcctaggtcagcccaaggctgccccctcggtcactctgttcccnccctcctccgtgtctgat

SEQ ID NO: 603395 - DNA, 486 bp, Homo sapiens; identical to SEQ ID NO: 535523
  misc_feature: HIJSMM301BNBD9.22.73.G07.1.454.light.4.raw

SEQ ID NO: 603396 - DNA, 492 bp, Homo sapiens
  misc_feature: HIJSMM301DY4QR.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctctggccaccctgtctgtgtctccaggggaaagagtcaccctctcctgcagggccagtcagactattagtacaaacttggcctggtaccagcataaacctggccaggctcccaggctcctcatccatggtgcatcccccagggccactaatatcccagccaggttcagtggcagtgggtcggggtcagagttcactctcaccatcagcagcctgcagtctgaagattttgcagtttattactgtcagcagtatgatacctggcctccgtacacttttggccggggaccaagctggaaatcaagcgaactgtggctgcaccatctgtcttcatt

SEQ ID NO: 603397 - DNA, 502 bp, Homo sapiens; identical to SEQ ID NO: 538730
  misc_feature: HIJSMM301BUCUA.15.1.A01.1.454.light.4.raw

SEQ ID NO: 603398 - DNA, 446 bp, Homo sapiens
  misc_feature: HIJSMM301AVYJZ.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtctcggatctgggaccaaggtcaccgtcctaagtcagcccaaggccaacccctctgtcactctgttcccgccctcctccatactcgta

SEQ ID NO: 603399 - DNA, 494 bp, Homo sapiens; identical to SEQ ID NO: 534992
  misc_feature: HIJSMM301DG22P.9.1.A01.1.454.light.4.raw

SEQ ID NO: 603400 - DNA, 507 bp, Homo sapiens
  misc_feature: HIJSMM301DYLBE.8.1.A01.1.454.light.4.raw
ctcgcgtgtccacgaccggtgctcgatttagacgtctcatcagggggtgggctcaggaggcagagctctgggaatctcaccatggcctggacccctctcctgctcccctcctcactttctgcacagtctctgaggcctcctatgagctgacacagccaccctcggtgtcagtgtccccaggacaaacggccaggatcacctgctctggagatgaattgccaaagaaatatgcttattggtaccagcagaagtcaggccaggcccctgtcctggtcatttatgaggacaagaaacgaccctccgggatccctgacagactctctggctccagctcagggacagtggccaccttgactatcactggggcccaggtggaggatgaaggagactactattgttactctccagagaaggatggtcatcattgggtgttcggcgggagggaccaagtctggaccgtcctaagtcacgcccaaggctcgccccctcggcactctgtcccaccct

SEQ ID NO: 603401 - DNA, 503 bp, Homo sapiens
  misc_feature: HIJSMM301D61M0.15.56.F01.1.454.light.4.raw
tctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcggtgatgttgggacttacaaccttgtctcctggtaccaacatcacccaggcaaagcccccaaactcatgatttatgaggacaatgagcggccctcaggggtttctaatcgcttctctggctccaagtctgacaacacggcctccctgacaatctctgggctccaggctgaggacgagggtgattattactgctgcgcatatagaagtcccactgttgtacttttcggtcggagggaccaagctgaccgtcctaggtcagcccaaggctgccccctcggtcactctcgttcccgccctcctcgctacgtaga

SEQ ID NO: 603402 - DNA, 496 bp, Homo sapiens; identical to SEQ ID NO: 537225
  misc_feature: HIJSMM301AI9NU.11.59.F04.1.454.light.4.raw

SEQ ID NO: 603403 - DNA, 472 bp, Homo sapiens
  misc_feature: HIJSMM301AYJ91.10.87.H10.1.454.light.4.raw
catagtagtgcacgaccggtgctcgatttagcagtactgcgttgggtttgggggcaggagtcagacccagtcaggacacagcatggacatgagggtccccgctcagctcctggggctcctgctgctctggctcccaggttccagatgcgacatccagatgacccagtctccatcttccgtgtctgcatctgtaggagacagagtcaccatcacttgtcgggcgagtcagcctattagcagctggttagcctggtatcagcagaagccagggggagcccctaagctcctgatctatgctgcatccagtttgcagagtggggtcccgtcaaggttcagcggcagtggatctgggacagatttcgctctcaccatcaacaacctgcagcctgaggattttgcaacttactactgtcaacaggctagcagtttcccactcgactttcggccccggaccaagtggaggtcaaacgaa

SEQ ID NO: 603404 - DNA, 484 bp, Homo sapiens; identical to SEQ ID NO: 535400
  misc_feature: HIJSMM301DKI0L.46.26.C04.1.454.light.4.raw

SEQ ID NO: 603405 - DNA, 497 bp, Homo sapiens
  misc_feature: HIJSMM301ECX52.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtcctgggtcagcccaaggctgccccct

SEQ ID NO: 603406 - DNA, 457 bp, Homo sapiens
  misc_feature: HIJSMM301CJ9GM.49.85.H08.1.454.light.4.raw
agtcgagagacacgaccggtgctcgatttagtatcactcagtcgcggggtgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggataaatatgctggctggtatcagcagaagccaggccagtcccctgtgttggtcatctatcaagataccaagcggccctcagggatccctgagcgattctctggctccaactctgggaacacagccactctgaccatcagcgggactcaggctatcgatgaggctgactattactgtcaggcgtgggacagccgcactggggtattcgggcggagggaccaagctgaccgt

SEQ ID NO: 603407 - DNA, 485 bp, Homo sapiens
  misc_feature: HIJSMM301C3VAR.26.78.H01.1.454.light.4.raw
agactatactcacgaccggtgctcgatttagtgtgagtagtttgggtttggggcagagccctggggaggaactgctcagttaggacccagagggaaccatggaagcccctgctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccgagggtggaggatcagacgaa

SEQ ID NO: 603408 - DNA, 472 bp, Homo sapiens; identical to SEQ ID NO: 565737
  misc_feature: HIJSMM301ECI28.51.34.D01.1.454.light.4.raw

SEQ ID NO: 603409 - DNA, 384 bp, Homo sapiens; identical to SEQ ID NO: 540224
  misc_feature: HIJSMM301A5AIT.48.53.E09.1.454.light.4.raw

SEQ ID NO: 603410 - DNA, 446 bp, Homo sapiens; identical to SEQ ID NO: 537330
  misc_feature: HIJSMM301ATC4V.18.9.A09.1.454.light.4.raw

SEQ ID NO: 603411 - DNA, 528 bp, Homo sapiens
  misc_feature: HIJSMM301EZIJT.13.53.E09.1.454.light.4.raw
tcacgtactacacgaccggtgctcgatttagagagagtgtgttgggtttgggggcgaggagtcagtctcagtcaggaaacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaactcctgatctacggtacatccactttgcacagtgggatcccatcaaggttcagtggcagtagatctggaacagattttaccctcaccatcaggggtctacagcctgaagattttgcgacttactattgtcaacagagttaccttctccccccggacgttcggtccgaacggaccgaacggtagggaaagtacaagacggaactacgtagggtctcgcgaccaatactcgtcttctatcttccccg

SEQ ID NO: 603412 - DNA, 494 bp, Homo sapiens; identical to SEQ ID NO: 535629
  misc_feature: HIJSMM301D8SSE.4.27.C05.1.454.light.4.raw

SEQ ID NO: 603413 - DNA, 495 bp, Homo sapiens
  misc_feature: HIJSMM301BNETL.10.60.F05.1.454.light.4.raw
catagtagtgcacgaccggtgctcgatttagtacgtcatcagggaaaggggggggtctcaggaggcagcactctcgggacgtctccaccatggcctgggctctgctcctcctcagcctcctcactcagggcacaggatcttgggctcagtctgccctgactcagcctcgctcagtgtccgggtctcctggacagtcagttaccatctcctgcactggaacctccaatgatgttggtggttatatctatgtctcctggtaccaacaacacgcaggcaaagcccccgaagtcatgatttatgatgtcagtaagcggccctcaggggtccctgaccgcttctctggctccaagtctggcaacacggcctccctgaccatctctggcctccaggctgaggatgaggctgactattattgctgctcatatgcaggcggacctggttccgggtatgtcttcggaactgggaccacggtcaccgtcctaggtcagcccaagg

SEQ ID NO: 603414 - DNA, 502 bp, Homo sapiens
  misc_feature: HIJSMM301AXO69.41.71.G05.1.454.light.4.raw
tctatactatcacgaccggtgctcgatttagtgtcgtcgcaagagagaggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcaggttattaataattggttggcctggtatcagcagaaaccagggaaagcccctaaactcctgatctataaggcgtctactttagagagtggggtcccttcaaggttcagtggcagtggatctgggacagagttcaccctcaccatcggcagcctgcagcctgaagatatcgcaacttattactgtcaacaatataacacttattcaggggcattcggccaagggaccaaggtggaaattaaacgaactgtggctgcaccatctgtcttcatcttcccgt

SEQ ID NO: 603415 - DNA, 485 bp, Homo sapiens; identical to SEQ ID NO: 536723
  misc_feature: HIJSMM301D5ZCG.5.40.D07.1.454.light.4.raw

SEQ ID NO: 603416 - DNA, 486 bp, Homo sapiens; identical to SEQ ID NO: 535043
  misc_feature: HIJSMM301CCJA0.46.35.D02.1.454.light.4.raw

SEQ ID NO: 603417 - DNA, 484 bp, Homo sapiens; identical to SEQ ID NO: 535240
  misc_feature: HIJSMM301AWLRE.47.60.F05.1.454.light.4.raw

SEQ ID NO: 603418 - DNA, 488 bp, Homo sapiens; identical to SEQ ID NO: 557329
  misc_feature: HIJSMM301CMB44.4.33.C11.1.454.light.4.raw

SEQ ID NO: 603419 - DNA, 494 bp, Homo sapiens; identical to SEQ ID NO: 536477
  misc_feature: HIJSMM301EUIMV.22.5.A05.1.454.light.4.raw

SEQ ID NO: 603420 - DNA, 454 bp, Homo sapiens; identical to SEQ ID NO: 534964
  misc_feature: HIJSMM301DB4UU.19.86.H09.1.454.light.4.raw

SEQ ID NO: 603421 - DNA, 524 bp, Homo sapiens; identical to SEQ ID NO: 554741
  misc_feature: HIJSMM301DOL4H.40.27.C05.1.454.light.4.raw

SEQ ID NO: 603422 - DNA, 493 bp, Homo sapiens
  misc_feature: HIJSMM301A0RNF.27.78.H01.1.454.light.4.raw
  modified_base (403)..(403): a, c, t, g, unknown or other
  modified_base (487)..(487): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattacngtcatcagagtactactttacctcaagtgatcaccttccggcaagggacacgactggagattaaacgaactgtggctgcacatntgtctt

SEQ ID NO: 603423 - DNA, 510 bp, Homo sapiens
  misc_feature: HIJSMM301DW9BY.8.42.D09.1.454.light.4.raw
ctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctcggtcactctgttcccgcctccc

SEQ ID NO: 603424 - DNA, 507 bp, Homo sapiens; identical to SEQ ID NO: 544198
  misc_feature: HIJSMM301AGPA2.15.5.A05.1.454.light.4.raw

SEQ ID NO: 603425 - DNA, 496 bp, Homo sapiens
  misc_feature: HIJSMM301BXNQN.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtctaggtcagcccaaggccaaccc

SEQ ID NO: 603426 - DNA, 507 bp, Homo sapiens; identical to SEQ ID NO: 545328
  misc_feature: HIJSMM301DRMSN.8.33.C11.1.454.light.4.raw

SEQ ID NO: 603427 - DNA, 472 bp, Homo sapiens
  misc_feature: HIJSMM301BKOPN.10.87.H10.1.454.light.4.raw
catagtagtgcacgaccggtgctcgatttagcagtactgcgttgggtttgggggcaggagtcagacccagtcaggacacagcatggacatgagggtccccgctcagctcctggggctcctgctgctctggctcccaggttccagatgcgacatccagatgacccagtctccatcttccgtgtctgcatctgtaggagacagagtcaccatcacttgtcgggcgagtcagcctattagcagctggttagcctggtatcagcagaagccagggggagcccctaagctcctgatctatgctgcatccagtttgcagagtggggtcccgtcaaggttcagcggcagtggatctgggacagatttcgctctcaccatcaacaacctgcagcctgaggattttgcaacttactactgtcaacaggctagcagtttcccactcactttcggccccggaccaaagtggaggtcaaacgaa

SEQ ID NO: 603428 - DNA, 485 bp, Homo sapiens
  misc_feature: HIJSMM301A75YP.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgataactacttagcctggttgcagcacaaacctggccaggctcccaggctcctcatctatgctgcatccatcagggccactggcatcccaggcagattcagtggcagtgggtctgggacagacttcactctcaccatcagcagactggagcctgagattttgcagtctattactgtcagcagtatggtcacgtcccaagaacttttggtcaggggaccaagctggagatcaaacgaactgtggctgcaccat

SEQ ID NO: 603429 - DNA, 482 bp, Homo sapiens; identical to SEQ ID NO: 550464
  misc_feature: HIJSMM301DXQ0N.13.50.E06.1.454.light.4.raw

SEQ ID NO: 603430 - DNA, 490 bp, Homo sapiens
  misc_feature: HIJSMM301DD6O5.3.10.A10.1.454.light.4.raw
agacgcactccacgaccggtgctcgatttagcgtcgatctcagggggtgggtccaggaggcagaactctgggtgtctcaccatggcccggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtctaggtcagcccaaggccaaccccactgt

SEQ ID NO: 603431 - DNA, 502 bp, Homo sapiens; identical to SEQ ID NO: 556661
  misc_feature: HIJSMM301BBP93.13.11.A11.1.454.light.4.raw

SEQ ID NO: 603432 - DNA, 484 bp, Homo sapiens; identical to SEQ ID NO: 535400
  misc_feature: HIJSMM301A19JK.46.26.C04.1.454.light.4.raw

SEQ ID NO: 603433 - DNA, 466 bp, Homo sapiens; identical to SEQ ID NO: 552352
  misc_feature: HIJSMM301AYJOV.40.76.G10.1.454.light.4.raw

SEQ ID NO: 603434 - DNA, 498 bp, Homo sapiens
  misc_feature: HIJSMM301CVWSB.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgcagctcatatgcaggcagcaacagttttgtcttcggaactgggacccaggtcaccgtcctaggtcagcccaaggccaacccactgtcactctgttcccaccctcctctacgtcgtat

SEQ ID NO: 603435 - DNA, 486 bp, Homo sapiens
  misc_feature: HIJSMM301DUHUD.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaacgtcccgctcactttcggcggagggaccgaaggtggagatcaaacgaa

SEQ ID NO: 603436 - DNA, 498 bp, Homo sapiens
  misc_feature: HIJSMM301AHMQO.15.3.A03.1.454.light.4.raw
tctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtatcagaaaaaccaggacagcctcctaagctgctcatttactgggcatctacccgggaatccggggtccctgaccgattcagtggcagcgggtctggcacagatttcactctcaccatcagcagcctgcaggctgaagatgtggcagtttatactgtcagcaatatgaaagtattccttttactttcggccctgggaccaaacgtggatatacaacgaaactcgtggctgcaccatcttcg

SEQ ID NO: 603437 - DNA, 487 bp, Homo sapiens
  misc_feature: HIJSMM301DHNHM.19.57.F02.1.454.light.4.raw
tactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagatttgcaacttattttgtcaacaggctaacactttccccctcactttcggcggtagggaccaaggtggagatcaagcgaactgtggctgcaccat

SEQ ID NO: 603438 - DNA, 484 bp, Homo sapiens
  misc_feature: HIJSMM301AOF1V.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggccaagggaccaaggtaggaaatacaaacgaactagtggctgcaccta

SEQ ID NO: 603439 - DNA, 502 bp, Homo sapiens; identical to SEQ ID NO: 558110
  misc_feature: HIJSMM301C5VUS.4.6.A06.1.454.light.4.raw

SEQ ID NO: 603440 - DNA, 495 bp, Homo sapiens; identical to SEQ ID NO: 538269
  misc_feature: HIJSMM301A9KVA.9.1.A01.1.454.light.4.raw

SEQ ID NO: 603441 - DNA, 504 bp, Homo sapiens
  misc_feature: HIJSMM301D337F.19.85.H08.1.454.light.4.raw
  modified_base (455)..(455): a, c, t, g, unknown or other
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggngggaccaagctgaccgtcctgggtcagcccaaggctgccccctccggtc

SEQ ID NO: 603442 - DNA, 495 bp, Homo sapiens; identical to SEQ ID NO: 568544
  misc_feature: HIJSMM301AL5NW.40.50.E06.1.454.light.4.raw

SEQ ID NO: 603443 - DNA, 518 bp, Homo sapiens
  misc_feature: HIJSMM301D0BKB.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagccggtgatgaggctgacttatttttgtcaggtgtgggacagcagcatttatgtcttcggacctgggaccaaggtcaccgtcctaggtcagccccaaggccaaccccactgtcactctcgttcccaccctccctcga

SEQ ID NO: 603444 - DNA, 447 bp, Homo sapiens; identical to SEQ ID NO: 535201
  misc_feature: HIJSMM301D9SC7.18.9.A09.1.454.light.4.raw

SEQ ID NO: 603445 - DNA, 506 bp, Homo sapiens; identical to SEQ ID NO: 534969
  misc_feature: HIJSMM301BFM7J.18.37.D04.1.454.light.4.raw

SEQ ID NO: 603446 - DNA, 498 bp, Homo sapiens
  misc_feature: HIJSMM301APSI4.16.78.H01.1.454.light.4.raw
  modified_base (466)..(466): a, c, t, g, unknown or other
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgtatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggngatcaaacgactgtggctgcaccatctgtctt

SEQ ID NO: 603447 - DNA, 512 bp, Homo sapiens
  misc_feature: HIJSMM301DTA79.17.31.C09.1.454.light.4.raw
cgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttgggggcaaagctgccctgaccctttcgggtgcgcagcctgaggatgaggctgagtattactgcttgctctcctatagtggtgttcgggtgttcggcggagggaccaagctgaccgtctaggtcagccc

SEQ ID NO: 603448 - DNA, 484 bp, Homo sapiens; identical to SEQ ID NO: 568521
  misc_feature: HIJSMM301CM4QX.40.15.B04.1.454.light.4.raw

SEQ ID NO: 603449 - DNA, 508 bp, Homo sapiens
  misc_feature: HIJSMM301DQ33Q.17.28.C06.1.454.light.4.raw
cgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccgtgttcggcggagggaccaggctgaccgtcctaagtcagcccaaggctgcccccc

SEQ ID NO: 603450 - DNA, 493 bp, Homo sapiens; identical to SEQ ID NO: 535084
  misc_feature: HIJSMM301D0NFK.47.64.F09.1.454.light.4.raw

SEQ ID NO: 603451 - DNA, 492 bp, Homo sapiens
  misc_feature: HIJSMM301AEXEC.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatccaccagggccaccggtatcccagccaggttcagtggcagtgggtctgggacagagttcactctcaccatcagcagcctgcagtctgaggattttgcagtttattactgtcagcattacaataactggcctcggctcactttcggtcggagggaccgaacggtggagatacaaacgaactagtggcgtgcaccat

SEQ ID NO: 603452 - DNA, 502 bp, Homo sapiens; identical to SEQ ID NO: 549179
  misc_feature: HIJSMM301D8AAK.14.57.F02.1.454.light.4.raw

SEQ ID NO: 603453 - DNA, 509 bp, Homo sapiens; identical to SEQ ID NO: 553073
  misc_feature: HIJSMM301DDHBM.16.1.A01.1.454.light.4.raw

SEQ ID NO: 603454 - DNA, 494 bp, Homo sapiens; identical to SEQ ID NO: 535478
  misc_feature: HIJSMM301CTP0P.10.79.H02.1.454.light.4.raw

SEQ ID NO: 603455 - DNA, 522 bp, Homo sapiens
  misc_feature: HIJSMM301DDGGC.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaacccccactgtcactctcgttcccgccctcct

SEQ ID NO: 603456 - DNA, 498 bp, Homo sapiens
  misc_feature: HIJSMM301CL2X4.51.24.C02.1.454.light.4.raw
cgatcgtatacacgaccggtgctcgatttagtacagatcgttagggaaagggggatctgatcaggactcctcagttcaccttctcacaatgaggctccctgctcagctcctggggctgctaatgctctgggtcccagcatccagtggagatgttgtgctgactcagtctccactctccctgtccgtcacccttggacagccagcttccatctcctgcaggtctagtcaaagcctcgtttatagtgttggaaacacctacttgaattggtttcatcagaggccgggccaatctccaaggcgcctgatttataaggtttctaaccgggactctggggtcccagacagattcagcggcagtgggtcaggcactcatttcacactgaggatcagcagggtggaggctgaggatgttggggtttattactgcatgcaaggtacacactggcctcctatcaccttcggccaagggacacgactggaggttaaacgaactagtgg

SEQ ID NO: 603457 - DNA, 506 bp, Homo sapiens; identical to SEQ ID NO: 554189
  misc_feature: HIJSMM301BQWFV.19.78.H01.1.454.light.4.raw

SEQ ID NO: 603458 - DNA, 525 bp, Homo sapiens
  misc_feature: HIJSMM301BPTUS.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcccgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtccactctgttcccgccctcct

SEQ ID NO: 603459 - DNA, 482 bp, Homo sapiens
  misc_feature: HIJSMM301EMC9V.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccgggtccctgacaggttcagtggcagtggatcaggcacagattttacactgaaaatcagcagagtggaggctgaggatgttgggctctattattgcatgcaagctctacaagtccgctcactttcggcggagggaccaaggtggagatcaaacgaa

SEQ ID NO: 603460 - DNA, 506 bp, Homo sapiens
  misc_feature: HIJSMM301A5FBP.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgttcagcagtctgaagactggccgttcactttcggcggagggaccaaggtggacctcaaacgaactgtggctgcaccatctgtcttcatcttcccgcc

SEQ ID NO: 603461 - DNA, 489 bp, Homo sapiens; identical to SEQ ID NO: 544582
  misc_feature: HIJSMM301EKW5L.22.65.F10.1.454.light.4.raw

SEQ ID NO: 603462 - DNA, 504 bp, Homo sapiens
  misc_feature: HIJSMM301EXOGV.14.57.F02.1.454.light.4.raw
cgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccgggcatccccagccaggttcagtggcagcgggtctgggacagacttcactctcaccatcagcagcctagagtctgaagattttgcagtttattactgtcagcagcgggcaattggccgctcactttcggcgggggaccgaaggtggagttcaaacgaactgtggctgcaccatctgtcttcatcttcccg

SEQ ID NO: 603463 - DNA, 485 bp, Homo sapiens
  misc_feature: HIJSMM301BYUNL.40.83.H06.1.454.light.4.raw
tctagcgactcacgaccggtgctcgatttagatcacgtgcgtcgcggggcaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatgggtgttcggcggagggaccaaactgtccgtcctaggtcagacccg

SEQ ID NO: 603464 - DNA, 511 bp, Homo sapiens; identical to SEQ ID NO: 548214
  misc_feature: HIJSMM301AWJFJ.19.59.F04.1.454.light.4.raw

SEQ ID NO: 603465 - DNA, 489 bp, Homo sapiens; identical to SEQ ID NO: 536663
  misc_feature: HIJSMM301AU7WH.16.72.G06.1.454.light.4.raw

SEQ ID NO: 603466 - DNA, 505 bp, Homo sapiens; identical to SEQ ID NO: 535503
  misc_feature: HIJSMM301AF8EA.8.28.C06.1.454.light.4.raw

SEQ ID NO: 603467 - DNA, 476 bp, Homo sapiens; identical to SEQ ID NO: 537812
  misc_feature: HIJSMM301BPD27.3.82.H05.1.454.light.4.raw

SEQ ID NO: 603468 - DNA, 511 bp, Homo sapiens
  misc_feature: HIJSMM301BN6T1.8.28.C06.1.454.light.4.raw
  modified_base (382)..(382): a, c, t, g, unknown or other
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataaccggtncaatctgacgactttgctagtttatttctgtcagcagtctgaagactggccgttcactttcggcggagggaccgaaggtggacctacaaacgaactgtggctgcaccatctgtcttcatccttcccgcc

SEQ ID NO: 603469 - DNA, 449 bp, Homo sapiens
  misc_feature: HIJSMM301BR55G.26.72.G06.1.454.light.4.raw
  modified_base (426)..(426): a, c, t, g, unknown or other
  modified_base (443)..(443): a, c, t, g, unknown or other
  modified_base (446)..(446): a, c, t, g, unknown or other
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatatttcttgctccgtacncttgtcgaggccgacgnggngag

SEQ ID NO: 603470 - DNA, 501 bp, Homo sapiens; identical to SEQ ID NO: 579640
  misc_feature: HIJSMM301DBCFL.9.81.H04.1.454.light.4.raw

SEQ ID NO: 603471 - DNA, 496 bp, Homo sapiens; identical to SEQ ID NO: 535423
  misc_feature: HIJSMM301BJ9JZ.3.33.C11.1.454.light.4.raw

SEQ ID NO: 603472 - DNA, 494 bp, Homo sapiens; identical to SEQ ID NO: 534992
  misc_feature: HIJSMM301D7V09.9.1.A01.1.454.light.4.raw

SEQ ID NO: 603473 - DNA, 515 bp, Homo sapiens; identical to SEQ ID NO: 538805
  misc_feature: HIJSMM301DF70X.14.19.B08.1.454.light.4.raw

SEQ ID NO: 603474 - DNA, 513 bp, Homo sapiens; identical to SEQ ID NO: 565259
  misc_feature: HIJSMM301AKYFN.17.33.C11.1.454.light.4.raw

SEQ ID NO: 603475 - DNA, 486 bp, Homo sapiens; identical to SEQ ID NO: 535385
  misc_feature: HIJSMM301EKY7R.19.71.G05.1.454.light.4.raw

SEQ ID NO: 603476 - DNA, 515 bp, Homo sapiens
  misc_feature: HIJSMM301E3U5T.9.12.B01.1.454.light.4.raw
  modified_base (431)..(431): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaaacagtttttcncggggcgttggtccaagggacccgaaggtggaaagtacaaacgaaacctagtggctgcaccaactctgtcttctatcttccccg

SEQ ID NO: 603477 - DNA, 496 bp, Homo sapiens
  misc_feature: HIJSMM301AY4K2.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcacccatcaatagcctggaagctgaagatgctgcaacttattactgtcatcagagtactactttacctcaagtgatcaccttcggccaagggacacgactggagattaaacgaaactgtggctgcaccatctgtctt

SEQ ID NO: 603478 - DNA, 511 bp, Homo sapiens; identical to SEQ ID NO: 545382
  misc_feature: HIJSMM301DSJN3.15.34.D01.1.454.light.4.raw

SEQ ID NO: 603479 - DNA, 506 bp, Homo sapiens; identical to SEQ ID NO: 563474
  misc_feature: HIJSMM301D49Y6.10.27.C05.1.454.light.4.raw

SEQ ID NO: 603480 - DNA, 484 bp, Homo sapiens; identical to SEQ ID NO: 540581
  misc_feature: HIJSMM301EQ527.3.88.H11.1.454.light.4.raw

SEQ ID NO: 603481 - DNA, 496 bp, Homo sapiens
  misc_feature: HIJSMM301AW9BR.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtgaaatcaaacgaactgtggctgcacca

SEQ ID NO: 603482 - DNA, 493 bp, Homo sapiens; identical to SEQ ID NO: 543205
  misc_feature: HIJSMM301CU2L2.51.6.A06.1.454.light.4.raw

SEQ ID NO: 603483 - DNA, 518 bp, Homo sapiens
  misc_feature: HIJSMM301DVQO8.47.53.E09.1.454.light.4.raw
  modified_base (511)..(511): a, c, t, g, unknown or other
agctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcggggatgaggccgtatatttttgtcaggtgtgggagactaattttggtcatatgttgttcggcggagggaccaaggctgaccgtcctcggtcagcccaaggctgccccctcggtcactctgttcccnccctcct

SEQ ID NO: 603484 - DNA, 488 bp, Homo sapiens
  misc_feature: HIJSMM301B9JIK.4.82.H05.1.454.light.4.raw
agcactgtagcacgaccggtgctcgatttagtcgagctctctcgcggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacactgatggaaacacctacttgaattggtttcagcagaggccaggccaatctccaaggcgcctaatttataaggtttctaaccgggactctggggtcccagacagattcagcggcagtgggtcaggcactgattacacactgagaatcagcagggtggaggctgaggatgttggggtttattactgcatgcaagggacacactggccgtacacttttggccaggggaccaagctggagatcaaacgaactgtgg

SEQ ID NO: 603485 - DNA, 501 bp, Homo sapiens; identical to SEQ ID NO: 548094
  misc_feature: HIJSMM301DCO2H.41.45.E01.1.454.light.4.raw

SEQ ID NO: 603486 - DNA, 485 bp, Homo sapiens
  misc_feature: HIJSMM301BGYVP.22.6.A06.1.454.light.4.raw
acatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgctttttggtatcaacagaggccaggccacgcccctgtcttaatgatatataaagacagtgagaggccctcagggatctctgagcgattctctgcctccagctcagggacaacattcacattgaccatcagtgaagtccaggcagaagatgaggctgactattattgtcaatcaacagacagtagtgggaataatgtggtattcggcggagggaccaaactgaccgtcctaggtcagcccaaggctgccccccg

SEQ ID NO: 603487 - DNA, 482 bp, Homo sapiens
  misc_feature: HIJSMM301AK7V7.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactacccctctcactttcggcgggggaccaaggtggagatcaaacgaactagtggctgcacc

SEQ ID NO: 603488 - DNA, 489 bp, Homo sapiens
  misc_feature: HIJSMM301DQHDE.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaatttattactgtcagcaatataatacctggcctccgctcactttcggcggagggaccaaggttgagatcaaacgaactagtggctgcacca

SEQ ID NO: 603489 - DNA, 507 bp, Homo sapiens
  misc_feature: HIJSMM301D9UJ6.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagtacttcactctcaccatcatcagcctggagcctgaagatgttgcagtttattactgtcaacatcgtaccgagtggcctccgggggccactttcggccctgggaccaaagtggatatcaaacgaaactgtggctgcaccatctgtctt

SEQ ID NO: 603490 - DNA, 490 bp, Homo sapiens
  misc_feature: HIJSMM301AR99X.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattcttccagcgttcggccagggaccgaaggtggaagtcaagcgaactgtggctgcaccatctgtt

SEQ ID NO: 603491 - DNA, 509 bp, Homo sapiens
  misc_feature: HIJSMM301DWOLA.43.9.A09.1.454.light.4.raw
tgtgagtagtcacgaccggtgctcgatttagcgagacgcgcagggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggaactgtcaccagtggtcattatccctactggttccagcagaagcctggccaggccccccggacactgatttatgatacaagcaacaaactttcctggacacctgcccgattctcaggctccctccttggggcaaagctgccctgaccctttcgggtgcgcagcctgaggatgaggctgactattactgcttgctcgcctatgatgctgctcgggtttcgcggagggaccaagttgaccgcctaggtcagcccaaggctgccccctggtcactctgttcccaccctcctcactacct

SEQ ID NO: 603492 - DNA, 495 bp, Homo sapiens; identical to SEQ ID NO: 546624
  misc_feature: HIJSMM301CE1RA.52.38.D05.1.454.light.4.raw

SEQ ID NO: 603493 - DNA, 509 bp, Homo sapiens; identical to SEQ ID NO: 570701
  misc_feature: HIJSMM301ARRIQ.8.42.D09.1.454.light.4.raw

SEQ ID NO: 603494 - DNA, 496 bp, Homo sapiens
  misc_feature: HIJSMM301C8AHF.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagctgaaaccagggaaggcccctaaactcctgatctacgatgcatcgaacttggaaacaggggtcccatcaaggttcagtggaggtggatctggggacagattttactctcggcatccgcagcctgcagcctgaagattttgcgacatattactgtcaacagtatgaaaatgtcccgctcactttcggcgggggaccgaaggtggagttcaacgaactagtggctgcaccatctgtcttcatt

SEQ ID NO: 603495 - DNA, 490 bp, Homo sapiens; identical to SEQ ID NO: 538273
  misc_feature: HIJSMM301CLUTD.16.73.G07.1.454.light.4.raw

SEQ ID NO: 603496 - DNA, 488 bp, Homo sapiens; identical to SEQ ID NO: 572104
  misc_feature: HIJSMM301CC2KB.49.59.F04.1.454.light.4.raw

SEQ ID NO: 603497 - DNA, 506 bp, Homo sapiens
  misc_feature: HIJSMM301AYOO7.12.48.E04.1.454.light.4.raw
atacgacgtacacgaccggtgctcgatttagagagcgtcacagagagaaggggagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggagcggccccccgactcctcatctttaataacaatcagcggccctcaggggtccctgaccgattctctggctccaagtctggcacctcagcctccctggccatcagtgggctccagtctgaggatgaggctgattattactgtgcatcatgggctgacaccctgactgggtccgggagtgttcggcggagggaccaagctgaccgtcctaggtcagcccaaggcagccccctcggtcactc

SEQ ID NO: 603498 - DNA, 505 bp, Homo sapiens; identical to SEQ ID NO: 535503
  misc_feature: HIJSMM301BKUEN.8.28.C06.1.454.light.4.raw

SEQ ID NO: 603499 - DNA, 501 bp, Homo sapiens; identical to SEQ ID NO: 536142
  misc_feature: HIJSMM301ARJWG.15.1.A01.1.454.light.4.raw

SEQ ID NO: 603500 - DNA, 494 bp, Homo sapiens
  misc_feature: HIJSMM301B35Q0.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtacaaacgaactgtggctgcaccatctgtcttcattcc

SEQ ID NO: 603501 - DNA, 517 bp, Homo sapiens
  misc_feature: HIJSMM301AIBSY.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaggctgaccgtcctaggtcagcccaaggctgccccctggtcactctgttcccgccctcctcacg

SEQ ID NO: 603502 - DNA, 504 bp, Homo sapiens; identical to SEQ ID NO: 574695
  misc_feature: HIJSMM301D6GVA.48.28.C06.1.454.light.4.raw

SEQ ID NO: 603503 - DNA, 510 bp, Homo sapiens
  misc_feature: HIJSMM301EECUC.47.55.E11.1.454.light.4.raw
agctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagcccaaggcccaaccccac

SEQ ID NO: 603504 - DNA, 495 bp, Homo sapiens
  misc_feature: HIJSMM301B4844.2.49.E05.1.454.light.4.raw
acgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagagcggcccccaagctcctcatctatagaaattatgaacggtcctcaggggtccctgaccgattctctggctccaagtctggcacctcagcctccctggccatcagtgggctccggtccgaggatgaggctgattattactgtgttggatgggacagcagcctgagtgcttatgtctcggaactgggaccacggtcaccgtct

SEQ ID NO: 603505 - DNA, 490 bp, Homo sapiens; identical to SEQ ID NO: 547085
  misc_feature: HIJSMM301BQHVE.12.51.E07.1.454.light.4.raw

SEQ ID NO: 603506 - DNA, 507 bp, Homo sapiens; identical to SEQ ID NO: 590226
  misc_feature: HIJSMM301CY8JV.13.11.A11.1.454.light.4.raw

SEQ ID NO: 603507 - DNA, 494 bp, Homo sapiens
  misc_feature: HIJSMM301C213Y.13.39.D06.1.454.light.4.raw
tcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcacttcggtcggagggaccaaggtggaggatacaaacgaaa

SEQ ID NO: 603508 - DNA, 505 bp, Homo sapiens
  misc_feature: HIJSMM301EA8XM.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttattttttacagctccaccaataagagttacttagcttggttccagcagaaaccaggacatcgtcctgcactgctctatttactgggcgtctacccgggaatccggggtccctgaccgattcagtggcaggcgggtctgggacagatttcactctcaccatcagcagcctgcaggctgaagatgtggctagtttattattgtcagcaattattatattccctcctcagtacgttcggccaagggaccaaggtggaaatcaaacgactggtggctgcaccta

SEQ ID NO: 603509 - DNA, 512 bp, Homo sapiens
  misc_feature: HIJSMM301AR3VY.49.59.F04.1.454.light.4.raw
agtcgagagacacgaccggtgctcgatttagtacacacacttagggattgggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtactggtcatctatgaggacaccaaacgaccctccgggatccctacgagattctctggctccagtttagggacagtggccaccctgacagtcagtggggcccaggtggaggatgagggtgattactactgttactcaacagacattactactactcatagggtgttcggcggagggaccaagctgaccgtcctaggtcagcccaaggctgccccctcggtcactctgttcccaccct

SEQ ID NO: 603510 - DNA, 501 bp, Homo sapiens; identical to SEQ ID NO: 583547
  misc_feature: HIJSMM301B2K4S.12.86.H09.1.454.light.4.raw

SEQ ID NO: 603511 - DNA, 484 bp, Homo sapiens; identical to SEQ ID NO: 535400
  misc_feature: HIJSMM301ALF8F.46.26.C04.1.454.light.4.raw

SEQ ID NO: 603512 - DNA, 522 bp, Homo sapiens
  misc_feature: HIJSMM301DNW1Y.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggtccgaacgggaccgaacggtacggaaagtacaacgacggaacctagtggcgtcgcgaccactctgtcttctactcttcccgt

SEQ ID NO: 603513 - DNA, 463 bp, Homo sapiens; identical to SEQ ID NO: 535062
  misc_feature: HIJSMM301CHR1G.11.73.G07.1.454.light.4.raw

SEQ ID NO: 603514 - DNA, 493 bp, Homo sapiens
  misc_feature: HIJSMM301CUKFK.49.82.H05.1.454.light.4.raw
agtcgagagacacgaccggtgctcgatttagtcgagctctctcgcgggcacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagcggccctcaggggtctctgatcgcttctctggctccacgtctggcagcacggcctccctgacaatctctgggctccaggctggggacgaggctgattattattgctgttcatatgccggtgatagtggccgaagggtgttcggcgga

SEQ ID NO: 603515 - DNA, 497 bp, Homo sapiens
  misc_feature: HIJSMM301DLA7I.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaaggctgaccgtcctaggtcagcccaaggctgccccctcggtcactctgttcccgccctcctcgagtgcgtct

SEQ ID NO: 603516 - DNA, 522 bp, Homo sapiens
  misc_feature: HIJSMM301A00ZG.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaattcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccgccct

SEQ ID NO: 603517 - DNA, 447 bp, Homo sapiens; identical to SEQ ID NO: 535020
  misc_feature: HIJSMM301EG3UT.18.9.A09.1.454.light.4.raw

SEQ ID NO: 603518 - DNA, 505 bp, Homo sapiens
  misc_feature: HIJSMM301B11PX.22.46.E02.1.454.light.4.raw
acatacgcgtcacgaccggtgctcgatttagactcatctacagggaaaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtccgtcaccatctcctgcactgggaccagcagtgatgttggtgcttataactatgtctcctggtaccagcaccacccaggcaaagccccccaatcttaatttttggtgtcaataaccgccctcaggggtccctgatcgcttctccggctccaagtctggcaacacggcctccctgaccatctctggactccaggctgacgatgagggtgacttttactgctgctcatatgcaggcaactataatatggtcttcggcggagggaccaaagtgaccgtcctaggtcagcccaaggctgccccctggtcactc

SEQ ID NO: 603519 - DNA, 519 bp, Homo sapiens; identical to SEQ ID NO: 541143
  misc_feature: HIJSMM301EP317.7.86.H09.1.454.light.4.raw

SEQ ID NO: 603520 - DNA, 486 bp, Homo sapiens; identical to SEQ ID NO: 535917
  misc_feature: HIJSMM301C5OVM.3.10.A10.1.454.light.4.raw

SEQ ID NO: 603521 - DNA, 494 bp, Homo sapiens; identical to SEQ ID NO: 534994
  misc_feature: HIJSMM301AK1TE.27.78.H01.1.454.light.4.raw

SEQ ID NO: 603522 - DNA, 487 bp, Homo sapiens
  misc_feature: HIJSMM301DFFYO.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcaggacactgatttcacactgaaaatcagcagggtggaggctgaggatgtcggggtttactactgcatgcagggtacactctggccgttcacttttggcctaggggaccaaactggatatcagacgaactgtgg

SEQ ID NO: 603523 - DNA, 503 bp, Homo sapiens
  misc_feature: HIJSMM301DTB8M.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacaccggcctccctgaccatctctgggctccaggctgatgacgaggctgattattactgcaggtcatatacaatcagcaacacttatgtcttcgggactgggaccaagatcaccgtcctaggtcagcccaaggccaacccactgtcta

SEQ ID NO: 603524 - DNA, 497 bp, Homo sapiens
  misc_feature: HIJSMM301DOIMR.52.86.H09.1.454.light.4.raw
cgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcaggaggacgaggctgactattattgtcaatcaacagacaccattaggtacttatgtcttcggaactgcgaccaaggtcaccgtcctgggtcagcccaaggccaacccactgtcact

SEQ ID NO: 603525 - DNA, 493 bp, Homo sapiens; identical to SEQ ID NO: 535278
  misc_feature: HIJSMM301BE2B4.51.81.H04.1.454.light.4.raw

SEQ ID NO: 603526 - DNA, 494 bp, Homo sapiens; identical to SEQ ID NO: 534992
  misc_feature: HIJSMM301AF4CY.9.1.A01.1.454.light.4.raw

SEQ ID NO: 603527 - DNA, 514 bp, Homo sapiens
  misc_feature: HIJSMM301B5TPM.15.34.D01.1.454.light.4.raw
tctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtgggcgtggcatttgggtgttcggcggagggaccaaactgaccgtcctaggtcagcccaaggctcgccccctcggtccactcttccg

SEQ ID NO: 603528 - DNA, 494 bp, Homo sapiens; identical to SEQ ID NO: 534994
  misc_feature: HIJSMM301EDVIF.27.78.H01.1.454.light.4.raw

SEQ ID NO: 603529 - DNA, 516 bp, Homo sapiens
  misc_feature: HIJSMM301C94NK.17.28.C06.1.454.light.4.raw
cgtagactagcacgaccggtgctcgatttagagctcacgtattgggtttggggggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgccccctggtcactctcgttcccgcct

SEQ ID NO: 603530 - DNA, 516 bp, Homo sapiens
  misc_feature: HIJSMM301D52LL.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcacccatctctggactgaagactgaggacgaggctgactactactgtcagtcttatgataacaccagggtggtgttcggcggagggaccaagctggccgtcctaggtcagcccaaggctgccccctcggtcactctgttccccgccctcctcgagtagtaca

SEQ ID NO: 603531 - DNA, 480 bp, Homo sapiens; identical to SEQ ID NO: 557442
  misc_feature: HIJSMM301BGMZT.8.53.E09.1.454.light.4.raw

SEQ ID NO: 603532 - DNA, 486 bp, Homo sapiens; identical to SEQ ID NO: 537238
  misc_feature: HIJSMM301ERRX2.19.71.G05.1.454.light.4.raw

SEQ ID NO: 603533 - DNA, 487 bp, Homo sapiens
  misc_feature: HIJSMM301D7S4K.13.87.H10.1.454.light.4.raw
  modified_base (484)..(484): a, c, t, g, unknown or other
tcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatctatgttgcatccactttgcaaagtggggtcccatcaaggttcagcggcagtggatctgggacagaattcactctcacaatcagcagcctgcagcctgaagattttgcaacttattactgtcaacagcttaatagttacccgctcagtttcggcggagggaccaaggtggagatcaaacgaactgtggctgcacatcngtt

SEQ ID NO: 603534 - DNA, 508 bp, Homo sapiens; identical to SEQ ID NO: 583220
  misc_feature: HIJSMM301AFKEN.5.24.C02.1.454.light.4.raw

SEQ ID NO: 603535 - DNA, 486 bp, Homo sapiens; identical to SEQ ID NO: 535458
  misc_feature: HIJSMM301ESUAC.7.75.G09.1.454.light.4.raw

SEQ ID NO: 603536 - DNA, 496 bp, Homo sapiens
  misc_feature: HIJSMM301BCLX4.51.12.B01.1.454.light.4.raw
cgatcgtatacacgaccggtgctcgatttagtagtgtagatttgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactctcg

SEQ ID NO: 603537 - DNA, 461 bp, Homo sapiens
  misc_feature: HIJSMM301CYN4R.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaacagaggtcccaccgaggttcagtggaagtggatctgggacagactttactctcaccatcagcagcctgcagcctgaagatattgcaacatattactgtcaacagtatgatcgtctcctcaatttcggcctgggaccagagtggacatagaacgaa

SEQ ID NO: 603538 - DNA, 495 bp, Homo sapiens; identical to SEQ ID NO: 555261
  misc_feature: HIJSMM301D6F71.51.71.G05.1.454.light.4.raw

SEQ ID NO: 603539 - DNA, 501 bp, Homo sapiens
  misc_feature: HIJSMM301ATO0N.47.66.F11.1.454.light.4.raw
  modified_base (474)..(474): a, c, t, g, unknown or other
agctcacgtacacgaccggtgctcgatttagtcacgcgagaagggggaggaactgctcagttaggacccagagggaaccatggaagccccagctcagcttctcttcctcctgctactctggctcccagaaatcgccggagacattctattgacacaggctccagtcaccctgtctttgtctccaggggaaagagccaccctctcctgcagggccagtcaaagcatcggcaacaatttggcctggtatcaacagaaacctggccaggctcccaggctcctcatctacgatgcatccaacagggccactggcgtcccaggcaggttcagaggcggtgggtctgggacagacttcactctcaccattgacggcctagagcctgaagattttgcagtttattactgtcagcagcgtaacaattggccgatcaccttcggccaagggacacgactggagattaaacgaactgtggctgnacccatctgtcttcatcttcccgccat

SEQ ID NO: 603540 - DNA, 480 bp, Homo sapiens
  misc_feature: HIJSMM301DSVKA.41.12.B01.1.454.light.4.raw
tctatactatcacgaccggtgctcgatttagtagtgtagattccgcggggaggaatcagacccagtcaggacacagcatggacatgagagtcctcgctcagctcctggggctcctgctgctctgtttcccaggtgccagatgtgacatccagatgacccagtctccgtcctcactgtctgcatctgtgggagacagagtcaccatcacttgtcgggcgagtcaggacattagcaattatttagcctggtttcagcagaaacccggcaacgcccctaaatccctaatctatgctgcatccactttgcgaagtggggtcccgtcaaagttcagcggcggcagatctgggacagacttcactctcaccatcagcaacctgcagcctgaagattttgcaacttattactgccaacaatacagcacgtttccctcactttcggcggaggaccagggtggagatcaaacgaactgtggctgcacat

SEQ ID NO: 603541 - DNA, 511 bp, Homo sapiens; identical to SEQ ID NO: 539247
  misc_feature: HIJSMM301DUFVW.15.34.D01.1.454.light.4.raw

SEQ ID NO: 603542 - DNA, 463 bp, Homo sapiens; identical to SEQ ID NO: 535062
  misc_feature: HIJSMM301BP5IW.11.73.G07.1.454.light.4.raw

SEQ ID NO: 603543 - DNA, 503 bp, Homo sapiens; identical to SEQ ID NO: 584633
  misc_feature: HIJSMM301EQCV2.43.38.D05.1.454.light.4.raw

SEQ ID NO: 603544 - DNA, 501 bp, Homo sapiens
  misc_feature: HIJSMM301CH4UV.48.35.D02.1.454.light.4.raw
agtatacatacacgaccggtgctcgatttagcacacgatagttgggtttggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgattattattgctgctcatatgcaggtggtactacttgggtgttcggcagagggaccaagctgaccgtcctaggtcagcccaaggctgccccccg

SEQ ID NO: 603545 - DNA, 484 bp, Homo sapiens
  misc_feature: HIJSMM301ATSOS.41.24.C02.1.454.light.4.raw
tctatactatcacgaccggtgctcgatttagtacagatcgttagggaaaggggctgggcctcaggaagcagcatcggaggtgcctcagccatggcatggatccctctcttcctcggcgtccttgcttactgcacaggatctgtggcctcctttgagctgactcagccaccctcagtgtccgtgtccccaggacagacagccagcatcacctgctctggagataaattggggaataaatatgcttcctggtatcagcagaagccaggccagtcccctgtgctggtcatctatcaaagttcccagcggccctcagggatccctgagcgattctctggctccaattctgggaacacagccactctgaccatcagcgggacccaggctatcgatgaggctgagtattactgtcaggcgtgggacatcagcactgaggtggtattcggcggagggaccaagctgaccgtccttggtcagcccaaggccg

SEQ ID NO: 603546 - DNA, 463 bp, Homo sapiens
  misc_feature: HIJSMM301B7UMV.10.9.A09.1.454.light.4.raw
catagtagtgcacgaccggtgctcgatttagcgagacgcgcagggggaggaactgctcagttaggacccagagggaaccatggaagccccagctcagcttctcttcctcctgctactctggctcccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccggggccactttcggccctgggaccaaagtggagatcaaacgaactgtggctgcaccatctgtcttcatcttcccgccactctgacactactatg

SEQ ID NO: 603547 - DNA, 505 bp, Homo sapiens
  misc_feature: HIJSMM301C81GX.10.27.C05.1.454.light.4.raw
catagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgcctctttcaaggtttttcggcggagggaccaggctgacgtcctaagtcagcccaaggctgcccctccggt

SEQ ID NO: 603548 - DNA, 484 bp, Homo sapiens; identical to SEQ ID NO: 537878
  misc_feature: HIJSMM301BBM9K.17.34.D01.1.454.light.4.raw

SEQ ID NO: 603549 - DNA, 512 bp, Homo sapiens
  misc_feature: HIJSMM301CLD6Y.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcggggcgttcggccaacgggaaccaagggtaggaaagtcaaacgaactacgtggctgcaccactctgtcttcatcttccccg

SEQ ID NO: 603550 - DNA, 519 bp, Homo sapiens
  misc_feature: HIJSMM301BEFFT.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactagtggctgcaccatctgtcttcatcttccccg

SEQ ID NO: 603551 - DNA, 501 bp, Homo sapiens; identical to SEQ ID NO: 546822
  misc_feature: HIJSMM301CER71.4.39.D06.1.454.light.4.raw

SEQ ID NO: 603552 - DNA, 517 bp, Homo sapiens; identical to SEQ ID NO: 541775
  misc_feature: HIJSMM301DOJXH.5.27.C05.1.454.light.4.raw

SEQ ID NO: 603553 - DNA, 517 bp, Homo sapiens
  misc_feature: HIJSMM301EZMYB.43.19.B08.1.454.light.4.raw
  modified_base (497)..(497): a, c, t, g, unknown or other
tgtgagtagtcacgaccggtgctcgatttagtgagtcagtaaggggagtctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcgttcggcggagggaccaagttgaccgtcctaagtcacgccaaggctcgccccctcggtcncttctcgttcccaccctcct

SEQ ID NO: 603554 - DNA, 497 bp, Homo sapiens
  misc_feature: HIJSMM301EDB5S.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaaactagtggctgcaccatctgtctttcatcttccccg

SEQ ID NO: 603555 - DNA, 496 bp, Homo sapiens
  misc_feature: HIJSMM301C7OVX.47.38.D05.1.454.light.4.raw
agctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggcctaggggaccaagctggagatcaaacgaactgtggctgca

SEQ ID NO: 603556 - DNA, 512 bp, Homo sapiens
  misc_feature: HIJSMM301CKGOK.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggtcggagggaccgaaaataagaggtacgaaacgaactagtggcgtgcaccactctgtcttctatt

SEQ ID NO: 603557 - DNA, 505 bp, Homo sapiens; identical to SEQ ID NO: 538054
  misc_feature: HIJSMM301C7A86.8.55.E11.1.454.light.4.raw

SEQ ID NO: 603558 - DNA, 485 bp, Homo sapiens
  misc_feature: HIJSMM301ECAQQ.4.57.F02.1.454.light.4.raw
agcactgtagcacgaccggtgctcgatttagctcgatatagttgggtttggggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaagattcagtggcagtggatctgggacagatttcactctcaccatcagtagtctacaacctgaagattttgcaacttactactgtcaacagagttacgatacccctccgctcactttcggcgagggaccaaggtggagatcaaacgaactgtggctgcacc

SEQ ID NO: 603559 - DNA, 516 bp, Homo sapiens; identical to SEQ ID NO: 545737
  misc_feature: HIJSMM301B5VQ1.17.33.C11.1.454.light.4.raw

SEQ ID NO: 603560 - DNA, 521 bp, Homo sapiens; identical to SEQ ID NO: 539470
  misc_feature: HIJSMM301A8ECT.27.23.C01.1.454.light.4.raw

SEQ ID NO: 603561 - DNA, 509 bp, Homo sapiens
  misc_feature: HIJSMM301EHSGX.52.57.F02.1.454.light.4.raw
cgcagtacgacacgaccggtgctcgatttagctcgatatagttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttatgactttgtctcctggtaccaacaccaccctggcaaagcccccaaactcatcatttttgaggtcactaagcggccctcaggggtccctgatcgcttctctggctcgaagtctggcaacacggcctccctgaccgtctctgggctccaggctgaggatgaggctgattactactgcacctcatatgcaggcacaacaatttgggggtttcgcggagggaccaaggtgaccgtctacgtcagcccaaggctgccccctggtcact

SEQ ID NO: 603562 - DNA, 507 bp, Homo sapiens
  misc_feature: HIJSMM301AQA7S.27.78.H01.1.454.light.4.raw
  modified_base (466)..(466): a, c, t, g, unknown or other
agcgtcgtctcacgaccggtgctcgatttagtgtgagtagtttgggtttggggagtcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtacccagcagaagccaggtcagtctccaaagctacctcatcaagtatgcttcccagtccttctcaggggtcccctcgaggttcagtggcagtggatctgggacacatttcaccctcaccatcaatagcctggaagctgagatgctgcaacttattactgtcatcagagtactacttacctcaagtnatcaccttccgaccaagggacaccgactggagattaaaacg

SEQ ID NO: 603563 - DNA, 506 bp, Homo sapiens
  misc_feature: HIJSMM301A4KGL.9.31.C09.1.454.light.4.raw
tgatacgtctcacgaccggtgctcgatttagacgtctcatcaaggaaggaaggggggggtctcaggaggcagcgctctcgggacgtctccaccatggcctgggctctgctattcctcaccctcctcactcagggcacagggtcttgggcccagtctgccctgactcagcctgcctccgtgtctgggtctcctggacagtcgatagccatctcctgcactggaactaacagtgacgttggtgcttataattatgtctcctggtatcaacaacacccaggcaaagccccccaactcattatttctgatgtcaacaatcggcccccagggatttctgatcgcttctctggctccaagtctggcaacacggcctccctgaccatctctgggctccgggctgaggacgaggctcactattactgcagctcatatacaaccagcgacactctgttgttcggcggagggactgaactgaccgtcctaggtcagcccaaggctgccccctcggt

SEQ ID NO: 603564 - DNA, 511 bp, Homo sapiens; identical to SEQ ID NO: 546062
  misc_feature: HIJSMM301DXTZJ.5.58.F03.1.454.light.4.raw

SEQ ID NO: 603565 - DNA, 502 bp, Homo sapiens
  misc_feature: HIJSMM301C9TTA.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagtattttgtcggtttattactgtcagcagtataataactggcctccacggtactacttttcggccgaggggaccaagctggagatacaaacgaactgtggctgcaccatctgt

SEQ ID NO: 603566 - DNA, 503 bp, Homo sapiens; identical to SEQ ID NO: 597036
  misc_feature: HIJSMM301CF11N.4.57.F02.1.454.light.4.raw

SEQ ID NO: 603567 - DNA, 463 bp, Homo sapiens; identical to SEQ ID NO: 535062
  misc_feature: HIJSMM301B1FC0.11.73.G07.1.454.light.4.raw

SEQ ID NO: 603568 - DNA, 505 bp, Homo sapiens; identical to SEQ ID NO: 536254
  misc_feature: HIJSMM301ANG82.7.71.G05.1.454.light.4.raw

SEQ ID NO: 603569 - DNA, 501 bp, Homo sapiens
  misc_feature: HIJSMM301CND6F.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggcccactggtactcccagccaggttcagtggcagtgggtctgggacagagttcactctcaccatcagcagcctgcagtctgaagattttgtcggtttattactgtcagcagtataataactggcctccacggtacacttttggccgaggggaccaagctggagatcaaacgaactgtggctgcaccatctgtt

SEQ ID NO: 603570 - DNA, 493 bp, Homo sapiens; identical to SEQ ID NO: 543949
  misc_feature: HIJSMM301BRFFL.16.68.G02.1.454.light.4.raw

SEQ ID NO: 603571 - DNA, 482 bp, Homo sapiens; identical to SEQ ID NO: 548246
  misc_feature: HIJSMM301AR1A3.48.19.B08.1.454.light.4.raw

SEQ ID NO: 603572 - DNA, 517 bp, Homo sapiens
  misc_feature: HIJSMM301ADBZO.8.42.D09.1.454.light.4.raw
ctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgagatgaggctgattattactgcagctcatattcaggcagcaacgagggtattcggcggagggaccaaggttcgaccgtcctaggtcacgcccgaaggctcgccccctcggtcactctcgttccgccctcccg

SEQ ID NO: 603573 - DNA, 519 bp, Homo sapiens
  misc_feature: HIJSMM301AYN3E.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcggtccaacggaccgaacggtaggaagtacgaaacgaactacgtggcgtgcaccactctcgtcttctactcttcccgtcctact

SEQ ID NO: 603574 - DNA, 496 bp, Homo sapiens; identical to SEQ ID NO: 536802
  misc_feature: HIJSMM301CM6TU.5.24.C02.1.454.light.4.raw

SEQ ID NO: 603575 - DNA, 395 bp, Homo sapiens
  misc_feature: HIJSMM301A05IA.49.25.C03.1.454.light.4.raw
agtcgagagacacgaccggtgctcgatttagtagtgtagatttgggtttggggtctgcatctgtaggagacagagtcaccatcacttgccaggcgagtcaggacattcgcaactatttaaattggtatcagcagaaaccagggaaagcccctaaactcttgatctacgatgtctccaatttggaaacaggggtcccatcaaggttcagtggaagtggatctgggacagattttactttcaccatcagcagcctgcagcctgaagatattgcaacatattactgtcaacagtatgataatctcccactcactttcggcggagggaccaaggtggagatcaaacgaactgtggctgcaccatctgtcttcatcttcccgccatctgatctctcgact

SEQ ID NO: 603576 - DNA, 474 bp, Homo sapiens
  misc_feature: HIJSMM301AFEF8.52.59.F04.1.454.light.4.raw
cgcagtacgacacgaccggtgctcgatttagtacacacacttagggattgggggcagaagtctctctcagccaggacacagcatggacatgagggtccctgctcagctcctgggactcctgctgctctggctcccagataccagatgtgacatccagatgacccagtctccatcctccctgtctgcatctgttggagacagagtcaccatctcttgccgggcgagtcaggtcattaacagttatttagcctggtatcagcaaaaaccagggcaagttcctgaactcctgatctatgacacatccactttgcaatcaggggtcccatctcggttcgttggcagtgggtctggggacagatttttactctcaccatcagcagcctgcagcctgaagatgttgcaacttatttctgtcataactatgatgatgcccctcacacgttcggccaagggaccaagctggaaatcaaacga

SEQ ID NO: 603577 - DNA, 491 bp, Homo sapiens
  misc_feature: HIJSMM301CMVVO.5.11.A11.1.454.light.4.raw
atcagacacgcacgaccggtgctcgatttagctacgactgcaggggtgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtgtacagtgatggaaacacctacttgaattggtttcagcagaggccaggccaatctccaaggcgcctaatttatgaggtttctaaccgggactctggggtcccagacagattcagcggcagtgggtcaggcactgatttcacactgaaaatcagcacggtggaggctgaggatgttggggtttatttctgcatgcaaggtacacactggccgtacacttttggccaggggaccaagctgggagatcaaacgaactgtggctgcacc

SEQ ID NO: 603578 - DNA, 505 bp, Homo sapiens
  misc_feature: HIJSMM301DG9NZ.9.12.B01.1.454.light.4.raw
  modified_base (430)..(430): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaactagttttcncgggcgttcggccaagggaccaaggtggaaatacaaacgaactagtggctgcaccatctgtcttcatcttccccg

SEQ ID NO: 603579 - DNA, 505 bp, Homo sapiens
  misc_feature: HIJSMM301BY1OZ.13.11.A11.1.454.light.4.raw
tcacgtactacacgaccggtgctcgatttagctacgactgcggggtaagggaggttgtgtccaccatggcctggactcctctcctcctcctgctcctctctcactgcacaggttcccttctcgcaggctgtgctgactcagccgtcttccctctctgcttctcctggagcgtcagccagtctcacctgcaccttgcgcagtggcaccaatgttggtccctatgacatatattgggtaccgacagaagccagggagtcctccccacgtttctcctgaggttcaggtcaaactcagataaacgacagggctctggagtccccagccgcttctctggatccaaggatgattccgccaacgcagggatattactcatctctgggctccagtctgacgatgaggctgactattactgtttgacttggcacaacaacgcctggatcttcggacctgggaccacggtcaccgtcctaggtcagcccaaggccaaccccactgtcactctgtt

SEQ ID NO: 603580 - DNA, 515 bp, Homo sapiens
  misc_feature: HIJSMM301C0D91.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaaggctggccgtcctaggtcagcccaaggctgccccctcggtcactctgttccccaccctcctcgatagtaca

SEQ ID NO: 603581 - DNA, 501 bp, Homo sapiens
  misc_feature: HIJSMM301DIBVS.18.23.C01.1.454.light.4.raw
tacgagtatgcacgaccggtgctcgatttagtacacgtgattagggattgggggagtcagacccagtcaggacacagcatggacacgaggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaagctgcagatgattggtccgtccagtttccaagatggggccccatcgagattccgcgtcagtggatctgggacagatttcactctcaccatcagcagcctgcagcctgaagattttgcaacttactattgtcaacaggctgacaggttcccgctgactttcggcggagggaccaaggtagagatcaaaggaactgtggctgcaccatctgtcttcattctcccgt

SEQ ID NO: 603582 - DNA, 517 bp, Homo sapiens
  misc_feature: HIJSMM301CPI4N.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcgaggttagttactacttatgttcttacggtaagttgggacgacggtccaccgtcctaggtccaggcccaacggcccaaaccccctacg

SEQ ID NO: 603583 - DNA, 504 bp, Homo sapiens
  misc_feature: HIJSMM301DDRA4.9.12.B01.1.454.light.4.raw
  modified_base (429)..(429): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttcncgggcgtcggtccaagggaccgaaggtggaaatcaaacgaactagtggctgcaccatctgtcttcatcttccccg

SEQ ID NO: 603584 - DNA, 509 bp, Homo sapiens; identical to SEQ ID NO: 541829
  misc_feature: HIJSMM301CPCMY.17.28.C06.1.454.light.4.raw

SEQ ID NO: 603585 - DNA, 508 bp, Homo sapiens
  misc_feature: HIJSMM301EZOM1.41.71.G05.1.454.light.4.raw
tctatactatcacgaccggtgctcgatttagtgtcgtcgcaagagagagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcaggttattaataattggttggcctggtatcagcagaaaccagggaaagcccctaaactcctgatctataaggcgtctactttagagagtggggtcccttcaaggttcagtggcagtggagtccgggacagagttccaccctcaccatcggcagcctgcagcctgaagatatcgcaacttattactgtcaacaatataacacttattcaggggcattcggccaagggaccaaggtaggaaattaaacgaactgtggctgcaccatctgtcttcatccttcccgccta

SEQ ID NO: 603586 - DNA, 507 bp, Homo sapiens
  misc_feature: HIJSMM301DU7A3.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaaatagaggtcaacgaactagtggctgcaccatctgtcttcacttccc

SEQ ID NO: 603587 - DNA, 476 bp, Homo sapiens; identical to SEQ ID NO: 539512
  misc_feature: HIJSMM301C68FJ.8.85.H08.1.454.light.4.raw

SEQ ID NO: 603588 - DNA, 487 bp, Homo sapiens; identical to SEQ ID NO: 536986
  misc_feature: HIJSMM301CQDN3.3.12.B01.1.454.light.4.raw

SEQ ID NO: 603589 - DNA, 502 bp, Homo sapiens; identical to SEQ ID NO: 541971
  misc_feature: HIJSMM301D627O.4.39.D06.1.454.light.4.raw

SEQ ID NO: 603590 - DNA, 501 bp, Homo sapiens
  misc_feature: HIJSMM301CED8O.48.85.H08.1.454.light.4.raw
agtatacatacacgaccggtgctcgatttagtatcactcagtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcggggggaccaggctgaccgtcggcggtcagcccaaggctgccccctcggtcactctgttcccta

SEQ ID NO: 603591 - DNA, 494 bp, Homo sapiens
  misc_feature: HIJSMM301BY7G8.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggcagtttattactgtcagcagtattatactactcctctgacgttcggccgaaggaccaaggtgagatacaaacgaactgtggctgcaccat

SEQ ID NO: 603592 - DNA, 520 bp, Homo sapiens; identical to SEQ ID NO: 562605
  misc_feature: HIJSMM301DDKJD.27.23.C01.1.454.light.4.raw
  modified_base (517)..(517): a, c, t, g, unknown or other

SEQ ID NO: 603593 - DNA, 464 bp, Homo sapiens
  misc_feature: HIJSMM301CLLAT.8.49.E05.1.454.light.4.raw
  modified_base (411)..(411): a, c, t, g, unknown or other
ctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgggcaagtcagagcattggcacctacttaaattggtatcagcagaaaccagggaaagcccccaaactcctgatcaattatgcatccagtttgcaaagtggggtcccatcaagattcagtggcggtggatctgggacagatttcactctcaccatcaacagtctgcagattgaggattatgcaacttattactgtnagcagagttacacggaacccgctcacttcggtcggggacggaacggaagacgg

SEQ ID NO: 603594 - DNA, 501 bp, Homo sapiens
  misc_feature: HIJSMM301CHKXW.19.67.G01.1.454.light.4.raw
tactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttgctgggcttctacgcgcgaattcggggtccctgaccgattccggggcagcgggtctgggacagatttcactctcaccatcagcagcctgcaggctgaagatgtggcagttttatactgtcagcaatatttttctatcctccgtggacgttcggccaagggaccagggtggaaatcagacgaactgtggctgcacc

SEQ ID NO: 603595 - DNA, 490 bp, Homo sapiens
  misc_feature: HIJSMM301BELPH.17.25.C03.1.454.light.4.raw
cgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacacgttcccctcgctacttttggccaggggaccaaagttgagatacaaacgaactgtggctgcaccatctgtt

SEQ ID NO: 603596 - DNA, 465 bp, Homo sapiens; identical to SEQ ID NO: 547936
  misc_feature: HIJSMM301EYR0H.26.78.H01.1.454.light.4.raw

SEQ ID NO: 603597 - DNA, 521 bp, Homo sapiens; identical to SEQ ID NO: 539470
  misc_feature: HIJSMM301DP3RY.27.23.C01.1.454.light.4.raw

SEQ ID NO: 603598 - DNA, 511 bp, Homo sapiens
  misc_feature: HIJSMM301C7GG2.7.86.H09.1.454.light.4.raw
  modified_base (210)..(210): a, c, t, g, unknown or other
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctgggggganagccaccctctcctgcagggccagtgaaccttttagtagtagttatttagcctggtatcggcaaaaacctggccaggctccccgactcctcttctttggtggagcctacagggccactggcaccccagacatgatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttcatt

SEQ ID NO: 603599 - DNA, 486 bp, Homo sapiens; identical to SEQ ID NO: 548936
  misc_feature: HIJSMM301AR1TS.5.55.E11.1.454.light.4.raw

SEQ ID NO: 603600 - DNA, 487 bp, Homo sapiens
  misc_feature: HIJSMM301AKXW3.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcgagggtggaggctgaggatggttggggtttattactgcatgcaagctctacaaactccttacacttttggccagggaccaagctggagatcaaagaa

SEQ ID NO: 603601 - DNA, 501 bp, Homo sapiens
  misc_feature: HIJSMM301A4595.41.45.E01.1.454.light.4.raw
tctatactatcacgaccggtgctcgatttagtgagtcagtaagggaaaggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccgaagctgaccgtcctaggtcagcccaaggctgccccctcggtcact

SEQ ID NO: 603602 - DNA, 495 bp, Homo sapiens; identical to SEQ ID NO: 535596
  misc_feature: HIJSMM301ELWJZ.10.79.H02.1.454.light.4.raw

SEQ ID NO: 603603 - DNA, 496 bp, Homo sapiens; identical to SEQ ID NO: 591653
  misc_feature: HIJSMM301BOJCC.47.78.H01.1.454.light.4.raw

SEQ ID NO: 603604 - DNA, 503 bp, Homo sapiens; identical to SEQ ID NO: 538884
  misc_feature: HIJSMM301AKTXU.27.78.H01.1.454.light.4.raw

SEQ ID NO: 603605 - DNA, 515 bp, Homo sapiens; identical to SEQ ID NO: 558526
  misc_feature: HIJSMM301AK1CE.16.85.H08.1.454.light.4.raw

SEQ ID NO: 603606 - DNA, 486 bp, Homo sapiens; identical to SEQ ID NO: 535290
  misc_feature: HIJSMM301D3WBX.3.12.B01.1.454.light.4.raw

SEQ ID NO: 603607 - DNA, 490 bp, Homo sapiens
  misc_feature: HIJSMM301CE39C.16.53.E09.1.454.light.4.raw
  modified_base (418)..(418): a, c, t, g, unknown or other
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggttnttactgcatgcaagctctacaactccttacacttttggccaggggaccaagctggagatcaaagaactgtgg

SEQ ID NO: 603608 - DNA, 500 bp, Homo sapiens
  misc_feature: HIJSMM301CBRTB.41.71.G05.1.454.light.4.raw
tctatactatcacgaccggtgctcgatttagtgtcgtcgcaagagagaggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcaggttattaataattggttggcctggtatcagcagaaaccagggaaagcccctaaactcctgatctataaggcgtctactttagagagtggggtcccttcaaggttcagtggcagtggatctgggacagagttcaccctcaccatcggcagcctgcagcctgaagatatcgcaacttattactgtcaacaatataacacttattcaggggcattcggccaagggaccaaggtggaaattaacgaactgtggctgcaccatctgtcttcatcttcccg

SEQ ID NO: 603609 - DNA, 499 bp, Homo sapiens
  misc_feature: HIJSMM301DN05A.41.18.B07.1.454.light.4.raw
tctatactatcacgaccggtgctcgatttagtcgctgcgtaaggggggggagcctagctgtggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcgggcggggggaccgaagctgaccgtcctaggtcagcccaaggctcg

SEQ ID NO: 603610 - DNA, 485 bp, Homo sapiens
  misc_feature: HIJSMM301DBED9.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccaacagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcccgccctcctcgctacgtaga

SEQ ID NO: 603611 - DNA, 517 bp, Homo sapiens
  misc_feature: HIJSMM301ECTTH.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctcctgaccatctccgggctccagcctgaggacgaggctgattattattgtagttcatatacaaccagtgacacttgggtgttcggcggagggaccaggctgaccgtcctaggtcagcccaaggctgcccctcggtcactctgttccgcct

SEQ ID NO: 603612 - DNA, 521 bp, Homo sapiens; identical to SEQ ID NO: 538715
  misc_feature: HIJSMM301CBCFC.27.23.C01.1.454.light.4.raw

SEQ ID NO: 603613 - DNA, 500 bp, Homo sapiens; identical to SEQ ID NO: 546613
  misc_feature: HIJSMM301E2J3V.11.21.B10.1.454.light.4.raw

SEQ ID NO: 603614 - DNA, 519 bp, Homo sapiens
  misc_feature: HIJSMM301CS74K.47.53.E09.1.454.light.4.raw
agctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacggtcggggatggaggccgtatattttgtcaggtgtgggagactaatttggtcatatgttgttcggcggagggaccaagctgaccgtcctcggtcagcccaaggctgccccctcggtcactctgttcccaccctcctcc

SEQ ID NO: 603615 - DNA, 495 bp, Homo sapiens
  misc_feature: HIJSMM301BUXZS.13.42.D09.1.454.light.4.raw
tcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctcggacgttcggccgaaggaccgaaggtggaaatacgaaacgaactagtggctgcaccatctgtt

SEQ ID NO: 603616 - DNA, 383 bp, Homo sapiens; identical to SEQ ID NO: 540698
  misc_feature: HIJSMM301AHXYP.41.28.C06.1.454.light.4.raw

SEQ ID NO: 603617 - DNA, 485 bp, Homo sapiens; identical to SEQ ID NO: 544293
  misc_feature: HIJSMM301AQHPH.26.70.G04.1.454.light.4.raw

SEQ ID NO: 603618 - DNA, 504 bp, Homo sapiens
  misc_feature: HIJSMM301EVNPW.11.67.G01.1.454.light.4.raw
cgagagataccacgaccggtgctcgatttagagtatacatattgggtttgggggggttgagaagacaggactcaggacaatctccagcatggccagcttccctctcctcctcaccctcctcactcactgtgcagggtcctgggcccagtctgttctgactcagccaccctcagcgtctgggacccccgggcagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctggcacctcagcctccctggcctgcagtgggctccagtctgaggatgaggctgactattattgtgcagcgtgggatgacggtctgagtgctgtggtcttcggcggagggaccaagctgaccgtcctgggtcagcccaaggctgcccctcggtcact

SEQ ID NO: 603619 - DNA, 493 bp, Homo sapiens; identical to SEQ ID NO: 536246
  misc_feature: HIJSMM301B9LIT.49.66.F11.1.454.light.4.raw

SEQ ID NO: 603620 - DNA, 495 bp, Homo sapiens; identical to SEQ ID NO: 535486
  misc_feature: HIJSMM301EE2PT.26.72.G06.1.454.light.4.raw

SEQ ID NO: 603621 - DNA, 520 bp, Homo sapiens; identical to SEQ ID NO: 567791
  misc_feature: HIJSMM301DY6K6.27.23.C01.1.454.light.4.raw

SEQ ID NO: 603622 - DNA, 503 bp, Homo sapiens
  misc_feature: HIJSMM301BOHHW.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactggggctcaggcggaagatgaggctgactattactgtaactcccgggacagcagtgctgaccaggtggtattcggcggagggacccacctgaccgtcttaggtcagcccaaggctgccccctcggtccta

SEQ ID NO: 603623 - DNA, 493 bp, Homo sapiens
  misc_feature: HIJSMM301BC42R.13.56.F01.1.454.light.4.raw
tcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaagagccaccctctcctgcagggccagtcagacagttagcaacaacgtagcctggtaccagcagaaacgtggccaggctcccaggctcctcatctatggtgcatccaccagggccactggtatcccagaccggttcagtggcagtgggtctgggacagacttcactctcaccatcagcagtctgcagtctgaagatttgcagtttattactgtcagcagtataataactggcctccgtacatgtacacttttggcctaggggaccaacctggagatcagacgaa

SEQ ID NO: 603624 - DNA, 486 bp, Homo sapiens; identical to SEQ ID NO: 535043
  misc_feature: HIJSMM301A8U7W.46.35.D02.1.454.light.4.raw

SEQ ID NO: 603625 - DNA, 488 bp, Homo sapiens
  misc_feature: HIJSMM301E05CD.5.45.E01.1.454.light.4.raw
atcagacacgcacgaccggtgctcgatttagtgagtcagtaagggaaagggggcaggagtcagacccagtcaggacacagcatggacatgagggtccccgctcagctcctggggctcctgctgctctggttcccaggttccagatgcgacatccagatgacccagtctccttctttcgtgtctgcgtctgtaggagacagacttactatcgcttgtcgggcgagtcaggatattagtaccaggttagcctggtatcagcagaagcctgggagagcccctaaactcctgatctatgctgcatcaagtctgcaaagtggggtcccatcgaggttcagaggcagtggatctgggacagatttcactctcaccatcagcggcctgcagcctgaagattatgcaacttactattgtcaaagttctaatgtctttcccgcgcacgtttggccaggggaccaaggtagagatcaaacgaactgtggctgcaccta

SEQ ID NO: 603626 - DNA, 523 bp, Homo sapiens
  misc_feature: HIJSMM301AUIZX.10.28.C06.1.454.light.4.raw
catagtagtgcacgaccggtgctcgatttagagctcacgtattggggtttgggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctcaggggtttctgatcgcttctttgcctccaagtctggcaacacggcctccctgaccatctctgggctccagactgaggacgaggctgattattactgcagctcacatacaagcggcagcggttggggtgttcgggcggggggaccacactgaccgtcctaggtcagcccaaggctgccccctcggtcactctcgttccccg

SEQ ID NO: 603627 - DNA, 486 bp, Homo sapiens; identical to SEQ ID NO: 535043
  misc_feature: HIJSMM301EC321.46.35.D02.1.454.light.4.raw

SEQ ID NO: 603628 - DNA, 470 bp, Homo sapiens
  misc_feature: HIJSMM301C84GR.7.81.H04.1.454.light.4.raw
  modified_base (410)..(410): a, c, t, g, unknown or other
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacanagttccactaccccaatcacttcggccctgggactgaagtgcatatgaagagaactgtgg

SEQ ID NO: 603629 - DNA, 482 bp, Homo sapiens
  misc_feature: HIJSMM301EPK6I.49.81.H04.1.454.light.4.raw
agtcgagagacacgaccggtgctcgatttagtagtgtagattcgcgggggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggcggagggaccacggtggagatcaaacgaactgtggctgcaccatct

SEQ ID NO: 603630 - DNA, 459 bp, Homo sapiens
  misc_feature: HIJSMM301AMYYH.11.86.H09.1.454.light.4.raw
cgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcagcatgggatgacaccctgaatggtccttgtgtggttttcggcggagggaccaagctgaccgtcctaggtcagcccaaggctgccccctcggcactctgttcccaccctcctcgtatctctcg

SEQ ID NO: 603631 - DNA, 504 bp, Homo sapiens
  misc_feature: HIJSMM301A505G.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgaggcggttgggtgttcggcggagggaccaaactgaccgtcctaggtcagccccaa

SEQ ID NO: 603632 - DNA, 447 bp, Homo sapiens; identical to SEQ ID NO: 535020
  misc_feature: HIJSMM301AWDBY.18.9.A09.1.454.light.4.raw

SEQ ID NO: 603633 - DNA, 514 bp, Homo sapiens; identical to SEQ ID NO: 541418
  misc_feature: HIJSMM301BI0BH.17.33.C11.1.454.light.4.raw

SEQ ID NO: 603634 - DNA, 488 bp, Homo sapiens; identical to SEQ ID NO: 535725
  misc_feature: HIJSMM301EZJVI.12.88.H11.1.454.light.4.raw

SEQ ID NO: 603635 - DNA, 505 bp, Homo sapiens; identical to SEQ ID NO: 588626
  misc_feature: HIJSMM301CNZL1.2.35.D02.1.454.light.4.raw

SEQ ID NO: 603636 - DNA, 516 bp, Homo sapiens
  misc_feature: HIJSMM301EDCR8.47.53.E09.1.454.light.4.raw
agctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcggggatgaggccgtatatttttgtcaggtgtgggagactaattttggtcatatgttgttcggcggagggaccaagctgaccgtcctcggtcagcccaaggctgccccctcggtcactctgttcccgcctcct

SEQ ID NO: 603637 - DNA, 478 bp, Homo sapiens
  misc_feature: HIJSMM301DQXJK.51.60.F05.1.454.light.4.raw
cgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacctgagcgattctctggctcacctctgggaacacagccactctgaccatcagcgggacgcaggctgtggatgaggctgacttttactgtcaggcgtgggacagcgacactgccgtgttcggcggagggccaagctgaccgtcctcggtcagcccaaggctcg

SEQ ID NO: 603638 - DNA, 495 bp, Homo sapiens
  misc_feature: HIJSMM301BJXAW.3.33.C11.1.454.light.4.raw
agacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtctaggtcagcccaaggctgccccc

SEQ ID NO: 603639 - DNA, 494 bp, Homo sapiens
  misc_feature: HIJSMM301EM2M5.19.71.G05.1.454.light.4.raw
  modified_base (406)..(406): a, c, t, g, unknown or other
tactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatntggcagtttatattgtcaacaatattattatacttcgtggacgttcggccaagggaccaaggtggatatcagacgaactgtggctgca

SEQ ID NO: 603640 - DNA, 487 bp, Homo sapiens
  misc_feature: HIJSMM301EEWSE.51.42.D09.1.454.light.4.raw
cgatcgtatacacgaccggtgctcgatttagacacatacgcagggaaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaagagccaccctctcctgcagggccagtcagagtgtttctaacaacctagcctggtatcagcagaagcctggccaggctcccaggctcctcatctatggttcatccaccagggccgctgatatcccagccaggttcagtggcagtgggtctgggacagaattcactctcaccatcagcagcctgcagtctgaagattttgcagtttattactgtcagcagtatgataagtggcctccgtacacttttggccaggggaccaggctggagatcaaacgaactgtggctgcacca

SEQ ID NO: 603641 - DNA, 501 bp, Homo sapiens
  misc_feature: HIJSMM301ENSG5.53.11.A11.1.454.light.4.raw
cgcgtatacacacgaccggtgctcgatttagctacgactgcagggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaacaatatggatattggtaccggcagaagccaggccaggcccctgtgttggtaatatataaagacagggagacggcccccagggatccctgagcgatactctggctccagctcagggacaacagtcacattgaccatcagtggagtccaggcagaagacgaggctgactattactgtcaatctgcggacagcagtggttctcatgtggtattcggcggagggaccaagctgaccgtctaggtcacgcccaaggctcgccccctcggtccactcttccg

SEQ ID NO: 603642 - DNA, 508 bp, Homo sapiens; identical to SEQ ID NO: 554004
  misc_feature: HIJSMM301AN2VU.4.57.F02.1.454.light.4.raw

SEQ ID NO: 603643 - DNA, 499 bp, Homo sapiens; identical to SEQ ID NO: 536578
  misc_feature: HIJSMM301D1CGK.22.27.C05.1.454.light.4.raw

SEQ ID NO: 603644 - DNA, 507 bp, Homo sapiens
  misc_feature: HIJSMM301D7FPZ.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggtccaacgggaaccgaagggtgggaaatacaaaacgaaacctagtggctgcaccatctgtcttcactt

SEQ ID NO: 603645 - DNA, 491 bp, Homo sapiens
  misc_feature: HIJSMM301AEME5.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggacttttattactgtcagcagcgtgagttctggcctccgctcactttcggcggagggaccgagggtggagatcaaacgaactgtggctgcaccatctgtctt

SEQ ID NO: 603646 - DNA, 489 bp, Homo sapiens; identical to SEQ ID NO: 535139
  misc_feature: HIJSMM301B4DAA.14.55.E11.1.454.light.4.raw

SEQ ID NO: 603647 - DNA, 384 bp, Homo sapiens; identical to SEQ ID NO: 539298
  misc_feature: HIJSMM301AS4FB.41.26.C04.1.454.light.4.raw

SEQ ID NO: 603648 - DNA, 502 bp, Homo sapiens
  misc_feature: HIJSMM301A9PIO.43.69.G03.1.454.light.4.raw
tgtgagtagtcacgaccggtgctcgatttagtcgctgcgtaaaggagaaaggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccgaagctgaccgtcctaggtcagcccaaggctgccccctcggtcta

SEQ ID NO: 603649 - DNA, 521 bp, Homo sapiens; identical to SEQ ID NO: 539470
  misc_feature: HIJSMM301A9U72.27.23.C01.1.454.light.4.raw

SEQ ID NO: 603650 - DNA, 488 bp, Homo sapiens; identical to SEQ ID NO: 539884
  misc_feature: HIJSMM301A3RWC.7.85.H08.1.454.light.4.raw

SEQ ID NO: 603651 - DNA, 513 bp, Homo sapiens
  misc_feature: HIJSMM301AOCZP.3.37.D04.1.454.light.4.raw
agacgcactccacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccagcagtgacgttggtagatataattatgtctcctggtaccaacaactcccaggcaaacgcccccaaactgatgatttatgatgtcaataatcggccctcaggggtttctaatcgcttctctggctccaagtctggcaacacggcctccctgaccatctctgggctccagggtgaggacgaggctgatttattactgcagctcatttacaagcagcaccactcaggtcttcggaactgggactaaggtcaccgtcctaggtcagcccaaggccaacccccactgtcacttc

SEQ ID NO: 603652 - DNA, 511 bp, Homo sapiens; identical to SEQ ID NO: 541549
  misc_feature: HIJSMM301DN4JF.40.33.C11.1.454.light.4.raw

SEQ ID NO: 603653 - DNA, 497 bp, Homo sapiens; identical to SEQ ID NO: 536371
  misc_feature: HIJSMM301AR5KC.16.78.H01.1.454.light.4.raw

SEQ ID NO: 603654 - DNA, 521 bp, Homo sapiens
  misc_feature: HIJSMM301CLPV9.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggtccctgctgctgctgggtctggccatggtcgcccatggcctgctgcgcccaatggttgcaccgcaaagcggggacccagaccctggagcctcagttggaagcagccgatccagcctgcggagccgtgtggggcaggtcaggcccaaggccaaccccactcgtcactctcg

SEQ ID NO: 603655 - DNA, 501 bp, Homo sapiens
  misc_feature: HIJSMM301EYLGM.47.55.E11.1.454.light.4.raw
agctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctagggcacgtgagactcaggaaatgaccagaggggagtgaatgaggggtgcagagaactccatggctaccaggtcagcccaaggccaacccactgtcactctgttcccacctcctcta

SEQ ID NO: 603656 - DNA, 521 bp, Homo sapiens
  misc_feature: HIJSMM301DEITS.27.23.C01.1.454.light.4.raw
agcgtcgtctcacgaccggtgctcgatttagtacacgtgattggggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagtttcatatacaaccagtgacacttgggtgttcggcggagggaccaggctgaccgtcctaggtcagcccaaggctgccccctcggtcactctgttcccgcct

SEQ ID NO: 603657 - DNA, 484 bp, Homo sapiens
  misc_feature: HIJSMM301CP0SU.19.71.G05.1.454.light.4.raw
  modified_base (473)..(473): a, c, t, g, unknown or other
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcgccaaggaccaaggtggntatcagacgaa

SEQ ID NO: 603658 - DNA, 505 bp, Homo sapiens; identical to SEQ ID NO: 539292
  misc_feature: HIJSMM301AVHTS.19.85.H08.1.454.light.4.raw

SEQ ID NO: 603659 - DNA, 495 bp, Homo sapiens
  misc_feature: HIJSMM301CR1W3.51.14.B03.1.454.light.4.raw
cgatcgtatacacgaccggtgctcgatttagtgtgagtagttccgcgggggcaggagtcagaccccgtcaggacacagcatggacatgagggtccccgctcagctcctggggctcctgctgctctggttcccaggttccagatgcgacatccagatgacccagtctccatcctccgtgtctgcatctgtaggagacagagtcaccatgacttgtcgggcgagtcagggtattgacgactacttagcctggcttcagcagaaaccagggaaagcccccaagctcttgatctatgctgcatccaggttggaagtggggtcccatcaaggttcagcggcagtggatctgggacagatttcactctcaccatcagcagcctgcagcctgaagattttgcaacttattattgtcaacaggctaaaagttaccctctcactttcggcggagggaccaaggtagaaaccaaacgaactgtggctgcaccatctgtcttctac

SEQ ID NO: 603660 - DNA, 502 bp, Homo sapiens; identical to SEQ ID NO: 589985
  misc_feature: HIJSMM301EWFUB.2.76.G10.1.454.light.4.raw

SEQ ID NO: 603661 - DNA, 481 bp, Homo sapiens; identical to SEQ ID NO: 585620
  misc_feature: HIJSMM301DB76E.7.85.H08.1.454.light.4.raw

SEQ ID NO: 603662 - DNA, 493 bp, Homo sapiens
  misc_feature: HIJSMM301AGV1S.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagattacaattaccctcggacgttcggtccacgggaccgaacggtggaaagtacaaacgaactagtggctgcacca

SEQ ID NO: 603663 - DNA, 508 bp, Homo sapiens
  misc_feature: HIJSMM301C5663.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgtgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaaggctgaccgtcctaggtcagcccaaggctgccccccg

SEQ ID NO: 603664 - DNA, 447 bp, Homo sapiens; identical to SEQ ID NO: 535020
  misc_feature: HIJSMM301DKG80.18.9.A09.1.454.light.4.raw

SEQ ID NO: 603665 - DNA, 485 bp, Homo sapiens
  misc_feature: HIJSMM301BSLZT.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggccaagggaccgaaggtaggaaagtacaaacgaaactgtggctgcacca

SEQ ID NO: 603666 - DNA, 484 bp, Homo sapiens; identical to SEQ ID NO: 535400
  misc_feature: HIJSMM301AHTEL.46.26.C04.1.454.light.4.raw

SEQ ID NO: 603667 - DNA, 484 bp, Homo sapiens; identical to SEQ ID NO: 537878
  misc_feature: HIJSMM301AV6MX.17.34.D01.1.454.light.4.raw

SEQ ID NO: 603668 - DNA, 497 bp, Homo sapiens; identical to SEQ ID NO: 576418
  misc_feature: HIJSMM301DG6W2.27.78.H01.1.454.light.4.raw

SEQ ID NO: 603669 - DNA, 500 bp, Homo sapiens; identical to SEQ ID NO: 541423
  misc_feature: HIJSMM301EC7XA.10.71.G05.1.454.light.4.raw

SEQ ID NO: 603670 - DNA, 496 bp, Homo sapiens; identical to SEQ ID NO: 548829
  misc_feature: HIJSMM301A4SB6.16.10.A10.1.454.light.4.raw

SEQ ID NO: 603671 - DNA, 485 bp, Homo sapiens; identical to SEQ ID NO: 535609
  misc_feature: HIJSMM301B1YDM.46.35.D02.1.454.light.4.raw

SEQ ID NO: 603672 - DNA, 496 bp, Homo sapiens; identical to SEQ ID NO: 535109
  misc_feature: HIJSMM301AVK9V.16.78.H01.1.454.light.4.raw

SEQ ID NO: 603673 - DNA, 503 bp, Homo sapiens; identical to SEQ ID NO: 536834
  misc_feature: HIJSMM301DUVLZ.2.35.D02.1.454.light.4.raw

SEQ ID NO: 603674 - DNA, 498 bp, Homo sapiens; identical to SEQ ID NO: 539641
  misc_feature: HIJSMM301DW4HT.22.27.C05.1.454.light.4.raw

SEQ ID NO: 603675 - DNA, 505 bp, Homo sapiens
  misc_feature: HIJSMM301AHY1X.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagtgggtctgggacagatttcactctcaccatcagcagcctgcaggctgaagatgtggcagtttattactgtcaacagttttctcgggcgttcggccaagggaccaaggtaggaatacaaacgaactagtggctgcaccatctgtcttctatcttccccg

SEQ ID NO: 603676 - DNA, 493 bp, Homo sapiens
  misc_feature: HIJSMM301CHIJ2.40.81.H04.1.454.light.4.raw
tctagcgactcacgaccggtgctcgatttagtagtgtagattcgcgggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagattttacactgaaaatcagcagggtggaggcagaagatgttgggatttattactgcatgcaacctctacaaactgtgtggacggtcggccaagggaccaaggtggaaatcaagcgaactgtggctgcacct

SEQ ID NO: 603677 - DNA, 498 bp, Homo sapiens
  misc_feature: HIJSMM301B97SM.40.45.E01.1.454.light.4.raw
tctagcgactcacgaccggtgctcgatttagtgagtcagtaagggaaagggggaggaactgctcagttaggacccagagggaaccatggaagccccagctcagcttctcttcctcctgctactctggctcccagataccgccggagaaattgtgttgacacagtctccagccaccctgtctttatctccaggggaaagagccatcctctcctgcagggccagtcagaatattgatacatacttagcctggtaccagcagaaacctggcctggctcccagggtcctcatccatgatgcctcccacagggccactggcatcccacacaggttcagtggcagtgggtctgggacagacttcagtctcaccatcagcagcctagagcctgaggattttgcaatttatttctgtcaacagcgtagcacctggccccgggtcaccttcggccaagggacacgactggacatgaaacgaactgtggctgcaccatctgtcttcat

SEQ ID NO: 603678 - DNA, 464 bp, Homo sapiens; identical to SEQ ID NO: 536640
  misc_feature: HIJSMM301AVUWB.26.78.H01.1.454.light.4.raw

SEQ ID NO: 603679 - DNA, 383 bp, Homo sapiens; identical to SEQ ID NO: 540698
  misc_feature: HIJSMM301BF9P4.41.28.C06.1.454.light.4.raw

SEQ ID NO: 603680 - DNA, 484 bp, Homo sapiens
  misc_feature: HIJSMM301C9UWB.49.81.H04.1.454.light.4.raw
agtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggcggagggaccacggtggagatcaaacgaactgtggctgcaccatctgtcttcta

SEQ ID NO: 603681 - DNA, 516 bp, Homo sapiens; identical to SEQ ID NO: 542229
  misc_feature: HIJSMM301C3WDP.3.87.H10.1.454.light.4.raw

SEQ ID NO: 603682 - DNA, 495 bp, Homo sapiens; identical to SEQ ID NO: 536055
  misc_feature: HIJSMM301EOHYL.47.38.D05.1.454.light.4.raw

SEQ ID NO: 603683 - DNA, 506 bp, Homo sapiens
  misc_feature: HIJSMM301EWD8B.5.86.H09.1.454.light.4.raw
atcagacacgcacgaccggtgctcgatttagtgctatagacttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaatcgtgatttctgaggtcagtaagcggccctcaggggtccctgatcgcttctctggctccaagtctggcaacacggcctccctgaccgtctctgggctccagactgaggatgaggctgacttattactgcagctcatttgcaggcagccgtatactcttcggcggagggaccaagctgaccgtcctaggtcagcccaaggctgccccctcggtctacc

SEQ ID NO: 603684 - DNA, 478 bp, Homo sapiens
  misc_feature: HIJSMM301DD70F.43.60.F05.1.454.light.4.raw
  modified_base (439)..(439): a, c, t, g, unknown or other
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgtcgtcncggaccgacggcggagtgtctagagactagtggtcgtgc

SEQ ID NO: 603685 - DNA, 510 bp, Homo sapiens
  misc_feature: HIJSMM301AMDFF.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatacgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctgccccctcggtcactctgtt

SEQ ID NO: 603686 - DNA, 503 bp, Homo sapiens
  misc_feature: HIJSMM301DGOJC.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcacgtcctaggtcagcccaaggccaaccccactgtcta

SEQ ID NO: 603687 - DNA, 488 bp, Homo sapiens
  misc_feature: HIJSMM301CWBFG.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaaattattactgctgctcatatgaaggttataacaactatactattcggcggagggaccaagctgaccgtcctgcgtcagcccaaggctgccccctcggtcactctcgttcccaccctcctcgctacgtaga

SEQ ID NO: 603688 - DNA, 513 bp, Homo sapiens
  misc_feature: HIJSMM301BG3O1.43.23.C01.1.454.light.4.raw
tgtgagtagtcacgaccggtgctcgatttagtacacgtgattagggattggggtctggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcgggggcaaagctgccctgacactgtcaggtgtgcagcctgaggacgaggctgactattactgcctgctcatatatggtggcgcgtgggtgttcggcggagggaccaagctgaccgtcctgggtcagcccaaggctgccccctggtcactctgttcccaccct

SEQ ID NO: 603689 - DNA, 475 bp, Homo sapiens
  misc_feature: HIJSMM301AMOZL.13.76.G10.1.454.light.4.raw
tcacgtactacacgaccggtgctcgatttagtcactcatacaggggtgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagtgggacccaggctatggatgaggctgactattactgtcaggcgtgggacagcagcactgcccgctatgtcttcggaactgggaccaaggtcaccgtcctaagtcagcccaac

SEQ ID NO: 603690 - DNA, 516 bp, Homo sapiens; identical to SEQ ID NO: 590064
  misc_feature: HIJSMM301A4BQ8.17.33.C11.1.454.light.4.raw

SEQ ID NO: 603691 - DNA, 487 bp, Homo sapiens
  misc_feature: HIJSMM301DOTRS.4.33.C11.1.454.light.4.raw
agcactgtagcacgaccggtgctcgatttagagtgagctcgttgggtttgggggagctacaacaggcaggcaggggcagcaaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggcggaggaccgaaggtggagatcaaacgaa

SEQ ID NO: 603692 - DNA, 494 bp, Homo sapiens
  misc_feature: HIJSMM301CFR3S.48.30.C08.1.454.light.4.raw
agtatacatacacgaccggtgctcgatttagtctgacgtcaaagggaaagggggaactgctcagttaggacccagacggaaccatggaagccccagcgcagcttctcttcctcctgctactctggctcccagatgtcactggagaaaaataatgacgcagtctccagcccccctgcctgtgtctccaggggaaagagccaccctctcctgcagggccagtcagagtattagcagtgacttaaccttctacaaccaggtttccaggctcctcatccatggtgcatccaccagggccactggtatctcagccaggttcagtgccagtgggcctgggacagagttcactctcaccatcaccagcctgcagtctgaagattttgcattttattactgtcagcactataataactggccacgtggacgttcggccaagggaccaaggtggaaatcaaacgaactgtggctgcaccatctgtcttcatcttcccgcccat

SEQ ID NO: 603693 - DNA, 479 bp, Homo sapiens; identical to SEQ ID NO: 546627
  misc_feature: HIJSMM301CLERL.11.11.A11.1.454.light.4.raw

SEQ ID NO: 603694 - DNA, 503 bp, Homo sapiens; identical to SEQ ID NO: 547049
  misc_feature: HIJSMM301CLWQA.18.59.F04.1.454.light.4.raw

SEQ ID NO: 603695 - DNA, 506 bp, Homo sapiens
  misc_feature: HIJSMM301BTKUJ.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatccccacccaggttcagtggcagtgggtctgggacagacttcattctcaccatccgcagcctagagcctgaagattttgcagtttattactgtcaacagcgtagcagcaggcctccggcgacgttcgccaaggaccaaggtgaagtcaagcgaactgtggctgcaccatctgtcttcatcttcccgcc

SEQ ID NO: 603696 - DNA, 423 bp, Homo sapiens
  misc_feature: HIJSMM301EPKHQ.9.34.D01.1.454.light.4.raw
tgatacgtctcacgaccggtgctcgatttagatcgtctgtgttgggtttgggggctgttcctggaagttgttggtaccagagggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtaacatcgtcttcggaactgggaccaaggtcaccgtcctgggtcagcccaaggcccaacccactgtcactctgttccccaccctcctcagacgtatca

SEQ ID NO: 603697 - DNA, 494 bp, Homo sapiens; identical to SEQ ID NO: 540913
  misc_feature: HIJSMM301DQF7J.26.72.G06.1.454.light.4.raw

SEQ ID NO: 603698 - DNA, 496 bp, Homo sapiens
  misc_feature: HIJSMM301CSQYV.53.38.D05.1.454.light.4.raw
cgcgtatacacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaaacaatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactattactgtcaatctgctgacagcagtggttctcatgtggtattcggcggagggaccaagctgaccgtcctaggtcagccaaggctcgccccctc

SEQ ID NO: 603699 - DNA, 497 bp, Homo sapiens; identical to SEQ ID NO: 536376
  misc_feature: HIJSMM301CMNMG.22.9.A09.1.454.light.4.raw

SEQ ID NO: 603700 - DNA, 482 bp, Homo sapiens
  misc_feature: HIJSMM301C3X8B.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtccgctcactttcggcggagggaccaaggtggagatcaacgaa

SEQ ID NO: 603701 - DNA, 468 bp, Homo sapiens
  misc_feature: HIJSMM301A9OKQ.49.76.G10.1.454.light.4.raw
  modified_base (426)..(426): a, c, t, g, unknown or other
agtcgagagacacgaccggtgctcgatttagtcactcatacagggggcaggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggacagcccctaagctcctgatcctcgatgcatccactttggaaacagggtcccatcaaggttcagtggaagtggctctgggacagattttactttcaccatcagcagactgcagcctgaagatattgcaacatattactgtcaacagtatgatagtctcccgntcactttcggcggaggaccaaggtgagatcaaacgaactgtc

SEQ ID NO: 603702 - DNA, 493 bp, Homo sapiens; identical to SEQ ID NO: 537281
  misc_feature: HIJSMM301EOYMQ.9.1.A01.1.454.light.4.raw

SEQ ID NO: 603703 - DNA, 482 bp, Homo sapiens
  misc_feature: HIJSMM301A8AA0.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctcccactttcggccctggaccaagtggatatcaaacgaactgtgctgcaccatctgtt

SEQ ID NO: 603704 - DNA, 497 bp, Homo sapiens
  misc_feature: HIJSMM301C64HA.40.23.C01.1.454.light.4.raw
tctagcgactcacgaccggtgctcgatttagtacacgtgattagggattggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagactttgctagtttattactgtcagcagcgtaccaactggccgctcactttcggcggagggaccaaggtggagatcaaacgaactgtggctgcaccatctgtcttcatt

SEQ ID NO: 603705 - DNA, 498 bp, Homo sapiens
  misc_feature: HIJSMM301BDUL9.16.78.H01.1.454.light.4.raw
  modified_base (461)..(461): a, c, t, g, unknown or other
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccagggaccgaanctggagatcaaacgaaactgtggctgcaccatctgtt

SEQ ID NO: 603706 - DNA, 497 bp, Homo sapiens
  misc_feature: HIJSMM301ASKOT.43.28.C06.1.454.light.4.raw
tgtgagtagtcacgaccggtgctcgatttagagctcacgtattgggtttggggtgactgatcaggactcctcagttcaccttctcacaatgaggctccctgctcagctcctggggctgctaatgctctgggtcccaggattaagtggcgaggttgtgatgactcagtctccactctccctgtccgtcacccttggacagccggcctccatctcctgcaggtctagtgaaggcctcctacacagtactggaggcacctacttgagttggtttcaccagaggccaggccaatctccaaggcgtctgatttataagatttctatccgggactctggggtcccagacaggttcagcggcagtgggtcagacactgacttcacactgagaatcagcagggtggaggctgaggatgttggaatttattactgcatgcaatcttcacactggcctccgtacacttttggccaggggaccaagctggagatcaaacgaactgtgg

SEQ ID NO: 603707 - DNA, 508 bp, Homo sapiens; identical to SEQ ID NO: 560372
  misc_feature: HIJSMM301BZK1D.8.33.C11.1.454.light.4.raw

SEQ ID NO: 603708 - DNA, 502 bp, Homo sapiens
  misc_feature: HIJSMM301DFBGN.48.78.H01.1.454.light.4.raw
agtatacatacacgaccggtgctcgatttagtgtgagtagtttgggtttggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgattattattgctgctcatatgcaggtggtactacttgggtgttcggcagagggaccaagctgaccgtcctaggtcagcccaaggctgccccctcc

SEQ ID NO: 603709 - DNA, 501 bp, Homo sapiens
  misc_feature: HIJSMM301B7967.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaggaccaaggtggaaatcaacgaactgtggctcacgactatcg

SEQ ID NO: 603710 - DNA, 475 bp, Homo sapiens; identical to SEQ ID NO: 537850
  misc_feature: HIJSMM301DU8WS.13.76.G10.1.454.light.4.raw

SEQ ID NO: 603711 - DNA, 508 bp, Homo sapiens; identical to SEQ ID NO: 550253
  misc_feature: HIJSMM301B24NX.9.55.E11.1.454.light.4.raw

SEQ ID NO: 603712 - DNA, 506 bp, Homo sapiens
  misc_feature: HIJSMM301EWGGL.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgactaacttattactgtcatcagagtactactttacctcaagtgatcaccttccggaccaagggaacacgactggagaattaaaaccgaactggtggctgccaccactctgttctt

SEQ ID NO: 603713 - DNA, 508 bp, Homo sapiens
  misc_feature: HIJSMM301BM6EM.40.47.E03.1.454.light.4.raw
tctagcgactcacgaccggtgctcgatttagactcgcgcacagagagaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccaataatgacgttggtggttacaactatgtctcctggtaccaacaatacccaggcaaagcccccaaactcctgatttatgaggtcagtaagcggccctcaggggtccctgatcgcttctctggctccaagtctgtcaacacggcctccctgaccgtctctgggctccaggctgaggatgaggctgtttactactgcagctcatatgcaggcagcaataattggtgttcggcgggggacaagctgaccgtcctaggtcagcccaaggctcgccccctcggtcta

SEQ ID NO: 603714 - DNA, 472 bp, Homo sapiens
  misc_feature: HIJSMM301E145O.52.19.B08.1.454.light.4.raw
cgcagtacgacacgaccggtgctcgatttagtgagtcagtaaggggagtcccaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttgccgggcgagtcgagacattagcatgtatctgaattggtatcagcaaaaagtagggacagcccctaaactcctgatcctcgatgcatccactttggagacaggggtcccatcaaggttcagtggaagtggctctgggacagattttactttcaccatcagcaggctgcagcctgaagatgttgcaacatattactgtcaacagtataatcgtctcccgctcactttcggcgggggaccgaaggtggagatcaagcgaactgtggctgcaccat

SEQ ID NO: 603715 - DNA, 503 bp, Homo sapiens; identical to SEQ ID NO: 545754
  misc_feature: HIJSMM301EDUN5.19.78.H01.1.454.light.4.raw

SEQ ID NO: 603716 - DNA, 509 bp, Homo sapiens; identical to SEQ ID NO: 553073
  misc_feature: HIJSMM301AHZG3.16.1.A01.1.454.light.4.raw

SEQ ID NO: 603717 - DNA, 486 bp, Homo sapiens; identical to SEQ ID NO: 535917
  misc_feature: HIJSMM301CBW78.3.10.A10.1.454.light.4.raw

SEQ ID NO: 603718 - DNA, 502 bp, Homo sapiens
  misc_feature: HIJSMM301D5EUI.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtggaatacaaacgaactgtggctgcaccatctgtcttcatcttccccg

SEQ ID NO: 603719 - DNA, 514 bp, Homo sapiens
  misc_feature: HIJSMM301AQ391.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggccaccccggacaggatcagtggcagcgggtctgggacagacttcattctcaccatcaacagactgcagcctgaagatattgcagtttactactgtcagcagtatgttacgtcccgtggacgttcggcaaggaccaaggtggcatcaaccgaactgtggctgcaccatctgtcttcatcttcccg

SEQ ID NO: 603720 - DNA, 514 bp, Homo sapiens
  misc_feature: HIJSMM301CIEN0.10.26.C04.1.454.light.4.raw
catagtagtgcacgaccggtgctcgattagtctagcgactttgggtttgggggctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaaggaccaggtgcaatcaaccgaactgtgctgcaccatctgtcttcattcttcccgccta

SEQ ID NO: 603721 - DNA, 492 bp, Homo sapiens
  misc_feature: HIJSMM301AE754.5.70.G04.1.454.light.4.raw
atcagacacgcacgaccggtgctcgatttagtgtagtgtgaagggaaaggggggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagtctgcaacctgaagattttgcaacttactactgtcaacagagttacggtacccccctcactttcggcggagggaccaaggttgagatcaaacgaactagtggctgcaccatctgtctt

SEQ ID NO: 603722 - DNA, 486 bp, Homo sapiens
  misc_feature: HIJSMM301AKQNR.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccatcacccctggagagccggcctccatctcctgcaggtctagccagagcctcttacatagtaatggattcaactatttgaattggtacctgcagaagccagggcagtctccacagctcctgatctgtttgggttctgatcgggcctccgggtccctgacaggttcagtggcagtggatcaggcacagattttacgctgaaaatcagtagggtggaggctgaggatgttggggtttattactgcatgcaagttctacaaacttcctacacttttggccaggggaccaagctggagatcaaacgaa

SEQ ID NO: 603723 - DNA, 521 bp, Homo sapiens; identical to SEQ ID NO: 539470
  misc_feature: HIJSMM301DDGFR.27.23.C01.1.454.light.4.raw

SEQ ID NO: 603724 - DNA, 499 bp, Homo sapiens; identical to SEQ ID NO: 602985
  misc_feature: HIJSMM301A0KDB.43.33.C11.1.454.light.4.raw

SEQ ID NO: 603725 - DNA, 509 bp, Homo sapiens
  misc_feature: HIJSMM301DXCHC.3.70.G04.1.454.light.4.raw
agacgcactccacgaccggtgctcgatttagtgtagtgtgaagggaaagggggaggaactgcgtcagttaggacccagagggaaccatggaagccccagctcagcttctcttcctcctgctactctggctcccagataacaccggacaaactgtgttgacacagtctccagccaccctgtctttgtccccaggggagacagccaccctctcctgcagggccagtcagagtgttaggggccacttagcctggtaccagcagaaacctggccagcctcccagtctcctcatctatggagcacacaacagggccactggcatcccagccaggttcagtggcagtgggtctgggacaggacttcaccctcatcatcagccgcctagagcctgaagattttgcagtttattactgtcagcagggttacttctggtcccactttcggccctgggaccaaacgtggatatcaaacgaactgtaggctgcaccatctgtcttcatcttcccgcctat

SEQ ID NO: 603726 - DNA, 494 bp, Homo sapiens; identical to SEQ ID NO: 549057
  misc_feature: HIJSMM301C9YSF.10.33.C11.1.454.light.4.raw

SEQ ID NO: 603727 - DNA, 512 bp, Homo sapiens
  misc_feature: HIJSMM301BRHF4.40.67.G01.1.454.light.4.raw
tctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtgggtctgggacagccttcactctcaccatcagcagcctggacgcccgaagattttgcggttttattactgtcagcagcgtgccgactcggccccctcacggttcggcggagggaccaaggtggacatcaaacgaactggtggctgcaccatctgtcttcatccttcccgcc

SEQ ID NO: 603728 - DNA, 507 bp, Homo sapiens; identical to SEQ ID NO: 564521
  misc_feature: HIJSMM301A336E.21.87.H10.1.454.light.4.raw

SEQ ID NO: 603729 - DNA, 485 bp, Homo sapiens; identical to SEQ ID NO: 570096
  misc_feature: HIJSMM301CVU4N.46.35.D02.1.454.light.4.raw

SEQ ID NO: 603730 - DNA, 478 bp, Homo sapiens; identical to SEQ ID NO: 535129
  misc_feature: HIJSMM301D9HTH.11.11.A11.1.454.light.4.raw

SEQ ID NO: 603731 - DNA, 494 bp, Homo sapiens; identical to SEQ ID NO: 535629
  misc_feature: HIJSMM301EG2SE.4.27.C05.1.454.light.4.raw

SEQ ID NO: 603732 - DNA, 496 bp, Homo sapiens
  misc_feature: HIJSMM301C2D18.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaaacaaagcctggccaggctcccagactcctcatctctggtgcatcttcgagggccactggtgtcccagccaggttcagtggcagtgggtctggaacaggagttcactctcaccatcagcggcctgcagtctgaagattttgctagtttattactgtcagcagtataatgacttgggttttattctactttcggccctgggaccaaagtggatttcagacgaactgtggctgcaccatctgtcttcta

SEQ ID NO: 603733 - DNA, 502 bp, Homo sapiens
  misc_feature: HIJSMM301BYMDB.27.78.H01.1.454.light.4.raw
  modified_base (494)..(494): a, c, t, g, unknown or other
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaaggacacgactgganattaaacg

SEQ ID NO: 603734 - DNA, 494 bp, Homo sapiens; identical to SEQ ID NO: 540664
  misc_feature: HIJSMM301DBF5C.47.64.F09.1.454.light.4.raw

SEQ ID NO: 603735 - DNA, 487 bp, Homo sapiens
  misc_feature: HIJSMM301COVWO.48.75.G09.1.454.light.4.raw
agtatacatacacgaccggtgctcgatttagtatagacatcagggggagtcaggacttctcagttcatcttctcaccatgaggctccctgctcagctcctggggctgctaatgctctggatccctggatccactgcgggtgttgtgttgacccaggctcccctgtctctgtccgtcacccctggacagccggccgccatgtcgtgcaattctagtcggagcctcttctatgaggacggcaggacctacttctattggtacatgcagaagccgggccggtctccacagctcctgatgtctgagatttccaggcgattccctggagtgccagagaggttcagtggcagcggagcagggacagagttcacactgaaatcagccgggtggaggctgaggatgttggcctttattactgcatgcaaggtatcttcctcccatacacttttggcccgggaccaaggtggatctcaaagaactgtggctgcacc

SEQ ID NO: 603736 - DNA, 499 bp, Homo sapiens; identical to SEQ ID NO: 545732
  misc_feature: HIJSMM301CE5HP.3.33.C11.1.454.light.4.raw

SEQ ID NO: 603737 - DNA, 518 bp, Homo sapiens
  misc_feature: HIJSMM301BWCEH.26.72.G06.1.454.light.4.raw
agactatactcacgaccggtgctcgatttagctacgactgcaagggaaaggggcagcaagatggtgttgcagacccaggtcttcatttcggtctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtacactttggtccagggaccgacggtggagatcagactgatattaactaagcgaaaagaagattttgtttaagggaaaggtaatgaagttaaa

SEQ ID NO: 603738 - DNA, 489 bp, Homo sapiens
  misc_feature: HIJSMM301CAM9M.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatccaccagggccaccggtatcccagccaggttcagtggcagtgggtctgggacagagttcactctcaccatcagcagcctgcagtctgaggattttgctagtttattactgtcagcattacaataactggcctcggctcactttcggcggagggaccaaggtggaggatacaaacgaactgtggctgcaccat

SEQ ID NO: 603739 - DNA, 505 bp, Homo sapiens; identical to SEQ ID NO: 536117
  misc_feature: HIJSMM301CVKPI.8.71.G05.1.454.light.4.raw

SEQ ID NO: 603740 - DNA, 500 bp, Homo sapiens
  misc_feature: HIJSMM301C6OXY.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaattattatattcctcctcagacgttcggccaagggaccaaggtaggaaatacaaacgaactgtgctgcaccta

SEQ ID NO: 603741 - DNA, 484 bp, Homo sapiens; identical to SEQ ID NO: 535400
  misc_feature: HIJSMM301DK5BF.46.26.C04.1.454.light.4.raw

SEQ ID NO: 603742 - DNA, 501 bp, Homo sapiens
  misc_feature: HIJSMM301B5HC9.19.85.H08.1.454.light.4.raw
tactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagccaaggctgcccctcggt

SEQ ID NO: 603743 - DNA, 500 bp, Homo sapiens; identical to SEQ ID NO: 535310
  misc_feature: HIJSMM301ESZZ2.47.66.F11.1.454.light.4.raw

SEQ ID NO: 603744 - DNA, 492 bp, Homo sapiens
  misc_feature: HIJSMM301BM5A7.13.42.D09.1.454.light.4.raw
tcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctcggacgttcggccaagggaccaaggtggaaatctaaacgaactgtggctgcaccatctgtt

SEQ ID NO: 603745 - DNA, 497 bp, Homo sapiens
  misc_feature: HIJSMM301BT2XG.12.87.H10.1.454.light.4.raw
atacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcattgggggaaaagtttgctttctggtatcagcagaagccaggccagtcccctgtcttggtcatctataaggatagcaggcggccctcagggattcctgagcgattctccggctccaactccggcaacacagccactctgaccatcagcgggacccaggctctcgatgaggctgaatattactgccaggcgtgggacagctccacttcccgttatgtcttcggaggtgggaccatggtcaccgtcctaggtcagcccaagaccaaccccactgt

SEQ ID NO: 603746 - DNA, 493 bp, Homo sapiens
  misc_feature: HIJSMM301C858A.43.36.D03.1.454.light.4.raw
  modified_base (443)..(443): a, c, t, g, unknown or other
tgtgagtagtcacgaccggtgctcgatttagctgcgtcacgatctctcttgggggagctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtatccccccaccatcagcacgccttagcctggtaccagcacaagtcagggcagcctcctaagttgctctttactggacttcgatccgcgcatctggggtccctgaccgattcatgggcagcggctctgggacagacttcgctctcaccatccaacagccctccaggctgaggatgcggtcggtttattattgtcaacaattattttagngctccgtactacttttggccagggggaccaaggttggagatccaaacgaa

SEQ ID NO: 603747 - DNA, 501 bp, Homo sapiens
  misc_feature: HIJSMM301CD4FF.10.43.D10.1.454.light.4.raw
catagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccacttcggccctcgggaccaaagtggatatcaaacgaactgtggctgcaccatctgtcttcat

SEQ ID NO: 603748 - DNA, 486 bp, Homo sapiens; identical to SEQ ID NO: 535043
  misc_feature: HIJSMM301DK4DA.46.35.D02.1.454.light.4.raw

SEQ ID NO: 603749 - DNA, 510 bp, Homo sapiens
  misc_feature: HIJSMM301D1X85.40.81.H04.1.454.light.4.raw
tctagcgactcacgaccggtgctcgatttagtagtgtagattcgcgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggcaacaattggtcttcggcggagggaccaagctgaccgtcctaggtcagcccaaggctgccccctcggtcactctcg

SEQ ID NO: 603750 - DNA, 512 bp, Homo sapiens
  misc_feature: HIJSMM301B4H5R.7.21.B10.1.454.light.4.raw
cgtgtctctacacgaccggtgctcgatttagtgtcgtcgcaagagaggaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctcgggaccgaaagtggatatcaaacgaactacgtggctgcaccatcctgtcttt

SEQ ID NO: 603751 - DNA, 497 bp, Homo sapiens
  misc_feature: HIJSMM301AR7K1.41.18.B07.1.454.light.4.raw
tctatactatcacgaccggtgctcgatttagtcgctgcgtaagggggtgtgggtccaggaggacagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaattttgttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaagctgaccgtcctaggtcagccaagctgccccctcggtcactcttcg

SEQ ID NO: 603752 - DNA, 494 bp, Homo sapiens; identical to SEQ ID NO: 534992
  misc_feature: HIJSMM301EBBNH.9.1.A01.1.454.light.4.raw

SEQ ID NO: 603753 - DNA, 508 bp, Homo sapiens; identical to SEQ ID NO: 552440
  misc_feature: HIJSMM301DV6RS.5.24.C02.1.454.light.4.raw

SEQ ID NO: 603754 - DNA, 481 bp, Homo sapiens
  misc_feature: HIJSMM301AOH2I.9.76.G10.1.454.light.4.raw
tgatacgtctcacgaccggtgctcgatttagtcactcatacagggggggtagagaagacaggactcaggacaatctccagcatggcctggtcccctctcttcctcaccctcatcactcactgtgcagggtcctgggcccagtctgtgctgactcagccaccctcggtgtctggagcccccaggcagagggtcaccatctcctgttctggaagcagctccaacatcggacataatggtgtaaactggtatcagcagctcccgggaaaggctcccaaactcctcatctattatgatgatctgctgccctcaggggtctctgaccgattctctggctccaagtctggcacctcagcctccctggccatcagtgggttccagtctgaggatgaggctgattattactgtggagcatgggatgacagcctgaatgcttggatgttcggcggagggaccaagctgaccgtcctaggtcagcccaagg

SEQ ID NO: 603755 - DNA, 487 bp, Homo sapiens
  misc_feature: HIJSMM301A5DNB.47.46.E02.1.454.light.4.raw
agctcacgtacacgaccggtgctcgatttagactcatctacagggaaaggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagtattttgctagttttattactgtcagcagtatcataactggccgctcaccttcggccaagggacacgactggagattaaacgaactgtggctgcaccat

SEQ ID NO: 603756 - DNA, 488 bp, Homo sapiens; identical to SEQ ID NO: 582456
  misc_feature: HIJSMM301EUXLA.47.38.D05.1.454.light.4.raw

SEQ ID NO: 603757 - DNA, 497 bp, Homo sapiens
  misc_feature: HIJSMM301DFIDC.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaatcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccc

SEQ ID NO: 603758 - DNA, 485 bp, Homo sapiens
  misc_feature: HIJSMM301DH6O0.47.46.E02.1.454.light.4.raw
agctcacgtacacgaccggtgctcgatttagactcatctacagggaaaggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgcagtttattactgtcagcagtatcataaactggccgctcaccttcggccaagggacacgactggagattaaacgaactgtggctgcaccat

SEQ ID NO: 603759 - DNA, 483 bp, Homo sapiens
  misc_feature: HIJSMM301D8XHW.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaagggcacgactggagattaaacgaactgtggctgcaccat

SEQ ID NO: 603760 - DNA, 507 bp, Homo sapiens
  misc_feature: HIJSMM301AGHWV.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcacctaatttataaggtttccaaccgggactctggggtcccagacagattcagcggcagtgggtcaggcactgatttcacactgggaatcagcagggtggaggctgaggatgttggggtttattactgcatgcaaactacacacggccgctcactttcggcggagggaccgaaggtggagatcaaacgaactgtggctgcaccatctgtt

SEQ ID NO: 603761 - DNA, 454 bp, Homo sapiens; identical to SEQ ID NO: 535005
  misc_feature: HIJSMM301AP9PH.19.86.H09.1.454.light.4.raw

SEQ ID NO: 603762 - DNA, 508 bp, Homo sapiens; identical to SEQ ID NO: 565391
  misc_feature: HIJSMM301CMGUP.5.58.F03.1.454.light.4.raw

SEQ ID NO: 603763 - DNA, 492 bp, Homo sapiens
  misc_feature: HIJSMM301D2KBA.13.46.E02.1.454.light.4.raw
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggcgtgaggatgttattgggctctattattgcatgcaagcaacacactggccgtacacttttggtccaggggaccaagctggagatcaatcgaactgt

SEQ ID NO: 603764 - DNA, 487 bp, Homo sapiens
  misc_feature: HIJSMM301EFDN2.10.2.A02.1.454.light.4.raw
catagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtggccaggctcccaggctcctcgtatatggtgcatccaccagggccactggtatctcaggcaggttccgtggcagtgggtctgggacagagttcactgtcaccatcagcagcctgcagtctgaagattttgcagtttattactgtcagcagtataatagctggcccgcgacgttcggccgaagggaccgaggtggaattcaaacgaactgtggctgcaccatctgtctt

SEQ ID NO: 603765 - DNA, 497 bp, Homo sapiens; identical to SEQ ID NO: 552235
  misc_feature: HIJSMM301B79FT.22.86.H09.1.454.light.4.raw

SEQ ID NO: 603766 - DNA, 519 bp, Homo sapiens
  misc_feature: HIJSMM301D4AVR.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcggtccaacggaccgaacggtaggaagtacgaaacgaacctagtggcgtgcgaccaactctgtcttcactcttcccgtcccact

SEQ ID NO: 603767 - DNA, 541 bp, Homo sapiens
  misc_feature: HIJSMM301C9ZYZ.22.87.H10.1.454.light.4.raw
acatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagccgccctcaatatctggggccccaggacagaaggtcaccatctcctgcactgggtacaactccaacatcggggcatataatgatgtccactggtaccagcaacttccagaaacagcccccaaactcctcatctatggtaacaacaatcggccctcaggggtccctgaccgattctctggctccaagtctggcatgtcagcctccctggcccatcacgtggcctccgaggctggaggatggaggctgtaatttatttctgaccctacgtaccttatggaccaaacgacggccctgggttcgtcccgggttgggttacgttccggggacggggaacgggaacccaaggcctacggacccgttccgttac

SEQ ID NO: 603768 - DNA, 519 bp, Homo sapiens
  misc_feature: HIJSMM301D5QHB.48.34.D01.1.454.light.4.raw
agtatacatacacgaccggtgctcgatttagatcgtctgtgttgggtttgggatttagatcgtctgtgttgggtttgggcttgatgccttggggtgggaggagagacccctctcctgctccccctcctcactttctgcacagtctctgaggcctcctctgagctgacacagccaccctcggtgtcagtgtccccaggacaaacggccaggatcacctgctctggagatgcattgccaagaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgttcccaccct

SEQ ID NO: 603769 - DNA, 503 bp, Homo sapiens
  misc_feature: HIJSMM301A5DBQ.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcattctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactacaggaaagacagcttccctgaccatcactggggctcaggcggaagatgaggctgactattactgtaactcccgggacagcagtgctgaccaggtggtattcggcggagggacccacctgaccgtcttaggtcagcccaaggctgccccctcggtcta

SEQ ID NO: 603770 - DNA, 482 bp, Homo sapiens
  misc_feature: HIJSMM301AOO50.11.76.G10.1.454.light.4.raw
cgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtccctgaccgattccgtggcagtggatctgggacaaatttcactctcaccatcaatagcctgcaggctgaagatgtggcagcttattattgtcagcaatattatacttctcttccgatcacttttggccaggggaccaggctggagatcagacgaaactgt

SEQ ID NO: 603771 - DNA, 488 bp, Homo sapiens; identical to SEQ ID NO: 536554
  misc_feature: HIJSMM301AKF4R.26.37.D04.1.454.light.4.raw

SEQ ID NO: 603772 - DNA, 493 bp, Homo sapiens; identical to SEQ ID NO: 540880
  misc_feature: HIJSMM301A5BSZ.40.81.H04.1.454.light.4.raw

SEQ ID NO: 603773 - DNA, 495 bp, Homo sapiens
  misc_feature: HIJSMM301EU2MR.22.57.F02.1.454.light.4.raw
acatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtgggtcccatcaaggttcagcggcactggatctgggacagaattcactctcaccatcaacagcctgcagcctgatgatttggcaacttactactgccaaccgtatagtacttattcggtcaccttcggccaagggacacgactggagattaaacgaactgtgg

SEQ ID NO: 603774 - DNA, 467 bp, Homo sapiens
  misc_feature: HIJSMM301DHVCR.51.34.D01.1.454.light.4.raw
cgatcgtatacacgaccggtgctcgatttagatcgtctgtgttgggtttgggggcagaagtctctctcagtcaggacacagcatggacatgagggtccctgctcagctcctgggactcctgctgctctggctcccagataccagatgtgacatccagatgacccagtctccatcctccctgtctgcatctataggagacagagtcaccatcacttgccgggcgagtcagggcgtcagcatttatttggcctggtatcagcagagaccagggaaagctcctaaactcctgatctatgaggcatccactttacaatcaggggtcccatctcgtttcagtggcagtggatctggggcacatttcactctcaccatcagcagcctgcagcctgacgatgttgcaacttattactgtcaaaattataacaggccgttgcgctcactttcggcgggggaccaaggtggagatc

SEQ ID NO: 603775 - DNA, 502 bp, Homo sapiens
  misc_feature: HIJSMM301A5YBJ.48.60.F05.1.454.light.4.raw
agtatacatacacgaccggtgctcgatttagtacgtcatcagggaaagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcgggcgtcggtccaagggaccgaacggtaggaaagtacaaacgaactagtggcgtgcacca

SEQ ID NO: 603776 - DNA, 509 bp, Homo sapiens
  misc_feature: HIJSMM301ADLUV.5.60.F05.1.454.light.4.raw
atcagacacgcacgaccggtgctcgatttagtacgtcatcagggaaaggggcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcacctcagcctccctggccatccgtgggctccagtctgaggatgagtctgattattactgtgcaacatgggatgacagcctgaatggtccggtattcggcggagggaccgaagctgaccgtcctcggtcagcccaaggctgcccccc

SEQ ID NO: 603777 - DNA, 440 bp, Homo sapiens
  misc_feature: HIJSMM301AY3CS.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctcctggccatcactgggctccagcctgaggatgaggctgattattactgtcagtcctttgacattaaactggatgtggtattcggcggagggacccacgtaaccgtcctaggtcagcccaaggctgccccctcggtcactctgttcccaccctcctcgtatctctcg

SEQ ID NO: 603778 - DNA, 492 bp, Homo sapiens; identical to SEQ ID NO: 539019
  misc_feature: HIJSMM301DOYRR.9.1.A01.1.454.light.4.raw

SEQ ID NO: 603779 - DNA, 494 bp, Homo sapiens; identical to SEQ ID NO: 539065
  misc_feature: HIJSMM301EAX1Y.11.81.H04.1.454.light.4.raw

SEQ ID NO: 603780 - DNA, 499 bp, Homo sapiens; identical to SEQ ID NO: 535698
  misc_feature: HIJSMM301DKF9B.12.86.H09.1.454.light.4.raw

SEQ ID NO: 603781 - DNA, 502 bp, Homo sapiens; identical to SEQ ID NO: 583049
  misc_feature: HIJSMM301BDQ3G.43.34.D01.1.454.light.4.raw

SEQ ID NO: 603782 - DNA, 506 bp, Homo sapiens; identical to SEQ ID NO: 551763
  misc_feature: HIJSMM301D463H.9.12.B01.1.454.light.4.raw

SEQ ID NO: 603783 - DNA, 495 bp, Homo sapiens; identical to SEQ ID NO: 535964
  misc_feature: HIJSMM301AOQKL.16.10.A10.1.454.light.4.raw

SEQ ID NO: 603784 - DNA, 512 bp, Homo sapiens
  misc_feature: HIJSMM301AMDO9.8.88.H11.1.454.light.4.raw
ctcgcgtgtccacgaccggtgctcgatttagcgacagcgagaacacacaaaggggggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttcatcttcccgc

SEQ ID NO: 603785 - DNA, 503 bp, Homo sapiens
  misc_feature: HIJSMM301EQBOZ.5.24.C02.1.454.light.4.raw
atcagacacgcacgaccggtgctcgatttagtacagatcgttaggggaaaggggggggtctcaggaggcagcgctctcaggacgtcaccaccatggcctgggctctgctcctcctcaccctcctcactcagggcacagggtcctgggcccaggctgccctgactcagcctccctccgcgtccggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctcctgaccgtctctgggctccaggctgaggatgaggctgattattactgtcagctcatatgcaggcagcagcagtccccatgtgatcttcggcggggggaccgaaggctgaccgtccgtacggtcacgcccaaggc

SEQ ID NO: 603786 - DNA, 504 bp, Homo sapiens
  misc_feature: HIJSMM301DE7BQ.48.25.C03.1.454.light.4.raw
agtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtgtcccagccaggttcactggcggtgggtctgggacagagttcactctcaccatcagcagcctgcagtctgaagattttacattttattactgtcagcagtatcgtaagtggactccgacgtttggccaagggaccaaggtggaagtcaaacgaactgtggctgcaccatctgtcttcatcttccgcc

SEQ ID NO: 603787 - DNA, 514 bp, Homo sapiens; identical to SEQ ID NO: 541418
  misc_feature: HIJSMM301DBQNP.17.33.C11.1.454.light.4.raw

SEQ ID NO: 603788 - DNA, 487 bp, Homo sapiens; identical to SEQ ID NO: 558047
  misc_feature: HIJSMM301C50GV.4.26.C04.1.454.light.4.raw

SEQ ID NO: 603789 - DNA, 501 bp, Homo sapiens; identical to SEQ ID NO: 535746
  misc_feature: HIJSMM301CF41M.18.11.A11.1.454.light.4.raw

SEQ ID NO: 603790 - DNA, 502 bp, Homo sapiens; identical to SEQ ID NO: 541971
  misc_feature: HIJSMM301ASB0E.4.39.D06.1.454.light.4.raw

SEQ ID NO: 603791 - DNA, 458 bp, Homo sapiens
  misc_feature: HIJSMM301CH04G.18.78.H01.1.454.light.4.raw
tacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccccactgtcactctgttcccaccctcctccatacctcgta

SEQ ID NO: 603792 - DNA, 500 bp, Homo sapiens; identical to SEQ ID NO: 542309
  misc_feature: HIJSMM301DGIAS.12.86.H09.1.454.light.4.raw

SEQ ID NO: 603793 - DNA, 508 bp, Homo sapiens; identical to SEQ ID NO: 554667
  misc_feature: HIJSMM301B8S21.2.21.B10.1.454.light.4.raw

SEQ ID NO: 603794 - DNA, 492 bp, Homo sapiens
  misc_feature: HIJSMM301CQ0CT.5.57.F02.1.454.light.4.raw
atcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctgaacgttcggccagggaccacagtggatatcaggcgaactgtggctgcaccatctgtctt

SEQ ID NO: 603795 - DNA, 506 bp, Homo sapiens
  misc_feature: HIJSMM301BGPWZ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtaggaaagtacaaacgaaactgtggctgcaccatctgtcttcatcttccccg

SEQ ID NO: 603796 - DNA, 499 bp, Homo sapiens
  misc_feature: HIJSMM301COZ7N.48.34.D01.1.454.light.4.raw
agtatacatacacgaccggtgctcgatttagatcgtctgtgttgggtttggggagagaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtctt

SEQ ID NO: 603797 - DNA, 496 bp, Homo sapiens
  misc_feature: HIJSMM301EPOYK.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggaccgaaggtggagttcaaacgaactagtggctgcaccatctgtcttctat

SEQ ID NO: 603798 - DNA, 516 bp, Homo sapiens; identical to SEQ ID NO: 543914
  misc_feature: HIJSMM301ATZEU.5.27.C05.1.454.light.4.raw

SEQ ID NO: 603799 - DNA, 506 bp, Homo sapiens; identical to SEQ ID NO: 564527
  misc_feature: HIJSMM301CVX1T.4.57.F02.1.454.light.4.raw

SEQ ID NO: 603800 - DNA, 483 bp, Homo sapiens
  misc_feature: HIJSMM301C6VWH.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccgcaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaaacacagcctccctgaccattactggactccagcctgaggacgaggctgactatactgctcagcatgggacagcggcctcaggacttatgtcttcggaactgggacccagttccgtcctaggtcagcccg

SEQ ID NO: 603801 - DNA, 491 bp, Homo sapiens
  misc_feature: HIJSMM301C1H57.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcatatttcgtgctccgtacacttttggccagggacccaggtggagatcagacgaactgtggctgcaccatctgtcttcatcttccg

SEQ ID NO: 603802 - DNA, 507 bp, Homo sapiens; identical to SEQ ID NO: 563344
  misc_feature: HIJSMM301E28Q9.3.79.H02.1.454.light.4.raw

SEQ ID NO: 603803 - DNA, 512 bp, Homo sapiens; identical to SEQ ID NO: 556539
  misc_feature: HIJSMM301EB39E.5.58.F03.1.454.light.4.raw

SEQ ID NO: 603804 - DNA, 494 bp, Homo sapiens
  misc_feature: HIJSMM301APKNC.51.59.F04.1.454.light.4.raw
cgatcgtatacacgaccggtgctcgatttagtacacacacttagggattgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtctcggaactgcgaccaaggtcaccgtcctgggtcagcccaaggcccaacccactgt

SEQ ID NO: 603805 - DNA, 479 bp, Homo sapiens; identical to SEQ ID NO: 553293
  misc_feature: HIJSMM301EIGC9.9.76.G10.1.454.light.4.raw

SEQ ID NO: 603806 - DNA, 503 bp, Homo sapiens
  misc_feature: HIJSMM301D3H0F.40.23.C01.1.454.light.4.raw
tctagcgactcacgaccggtgctcgatttagtacacgtgattagggattggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcccgaagactttgcagtttattactgtcagcagcgtaccaactggccgctcactttcggcggagggaccaaggtggagatcaaacgaactgtggctgcaccatctgtcttcatcttccccg

SEQ ID NO: 603807 - DNA, 498 bp, Homo sapiens
  misc_feature: HIJSMM301D78W5.15.25.C03.1.454.light.4.raw
tctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccgggtccctgacaggttcagtggcagtggatcaggcatagattttacactgaaaatcagcagagtggaggctgaggacgttggggtttattactgcatgcaaggtctacaaaccccgactcaccttcggccgagggacacgcctggagattaaacgaactgtggctgcaccat

SEQ ID NO: 603808 - DNA, 519 bp, Homo sapiens
  misc_feature: HIJSMM301EEAHY.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggacaaaaacctggccaggctccccgactcctcttctttggtggagcctacagggccactggcaccccagacaggatcagtggcagcgggtctgggacagacttcattctcaccatcaaacagactgcagcctgaagatattgcagtttactactgtcagcagtatgttacgtccccgtggacgttcggccaaggaccaaggtggcaatcaaccgaactgtggctgcaccatctgtcttcatcttccccg

SEQ ID NO: 603809 - DNA, 455 bp, Homo sapiens; identical to SEQ ID NO: 542524
  misc_feature: HIJSMM301ECH23.19.86.H09.1.454.light.4.raw

SEQ ID NO: 603810 - DNA, 491 bp, Homo sapiens
  misc_feature: HIJSMM301A0TXT.4.40.D07.1.454.light.4.raw
agcactgtagcacgaccggtgctcgatttagtgatagagcgtaacaacagagggggctgctcagttaggacccagaggcaaccatggaaaccccagcgcagcttctcttcctcctgctactctggctcccagataccacaggagaagttgtgttgacgcagtctccaggcaccctgtctttgtctccaggggagagggccaccctctcctgcaggaccagtcagagtgataccaactaactttttagcctggtaccaacagaaagctggccaggctcccaggctcctcatctatggtgcatccatcagggccactggcatcccagacaggttcagtggcagtgggtctgggacagacttcactctcatcatcaacagactggagcctgaggattctgcagtgtattactgtcaccagtatggtgggcgcgcgttttcggcgggggaccgaaggtggacatcaaacgaactagtggctgcaccatctgtctt

SEQ ID NO: 603811 - DNA, 480 bp, Homo sapiens; identical to SEQ ID NO: 535630
  misc_feature: HIJSMM301BA28W.40.59.F04.1.454.light.4.raw

SEQ ID NO: 603812 - DNA, 502 bp, Homo sapiens
  misc_feature: HIJSMM301D9BGP.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattaactgtaactcccgggccagcagtggtaacattgtgatattcggcggagggaccaaggtgaccgtcctacgtcagcccaaggcctcgcccccctcggtcactctccg

SEQ ID NO: 603813 - DNA, 491 bp, Homo sapiens
  misc_feature: HIJSMM301DSQ7P.51.71.G05.1.454.light.4.raw
cgatcgtatacacgaccggtgctcgatttagtgtcgtcgcaagagagagggggggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcacg

SEQ ID NO: 603814 - DNA, 503 bp, Homo sapiens
  misc_feature: HIJSMM301DYU53.7.31.C09.1.454.light.4.raw
  modified_base (436)..(436): a, c, t, g, unknown or other
cgtgtctctacacgaccggtgctcgatttagacgtctcatcaaggaaggaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataagtatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaagatgaggctgattatactgctgctcatatgcaggccncaaacagtgatctattcggcggagggaccaagctcgaccgtctaggtcagcccaaggctgccccctc

SEQ ID NO: 603815 - DNA, 518 bp, Homo sapiens
  misc_feature: HIJSMM301C4RR8.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaacacctcgtccgaacggacgacgactagtaggagttaaaggtaaacgtacgtggtcgtcgtcgaccaactcttcgttcttcctactactttcccccg

SEQ ID NO: 603816 - DNA, 504 bp, Homo sapiens; identical to SEQ ID NO: 556081
  misc_feature: HIJSMM301BT678.27.78.H01.1.454.light.4.raw

SEQ ID NO: 603817 - DNA, 487 bp, Homo sapiens
  misc_feature: HIJSMM301C2G7L.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctagttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcacccat

SEQ ID NO: 603818 - DNA, 506 bp, Homo sapiens
  misc_feature: HIJSMM301BWHHX.11.57.F02.1.454.light.4.raw
  modified_base (474)..(474): a, c, t, g, unknown or other
  modified_base (483)..(483): a, c, t, g, unknown or other
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaggaccaaggtggaagtcaagcgaacngtggctgcnccatctgtcttcatcttcccgcc

SEQ ID NO: 603819 - DNA, 476 bp, Homo sapiens; identical to SEQ ID NO: 538026
  misc_feature: HIJSMM301EX3F6.13.76.G10.1.454.light.4.raw

SEQ ID NO: 603820 - DNA, 489 bp, Homo sapiens
  misc_feature: HIJSMM301CDDY2.48.38.D05.1.454.light.4.raw
agtatacatacacgaccggtgctcgatttagtatctgatagttgggtttggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgccccc

SEQ ID NO: 603821 - DNA, 513 bp, Homo sapiens
  misc_feature: HIJSMM301C1NGA.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcaactctcaccatcgctgatctgcagcctgaagattttgcaacttactactgtcaacagagtttcagtgtcccccggacgttcgtccacgggaccgacgacgtagaaatagagacgaactagtggcgtgcaccactctcgtcttctactcttcccgt

SEQ ID NO: 603822 - DNA, 455 bp, Homo sapiens
  misc_feature: HIJSMM301E0WFG.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctagggatgacagtgtgaacggtccggttttcggcggagggaccaagctgaccgtcctaagtcagcccaaggctgccccctcggtcactctgttcccaccctcctccacgagagta

SEQ ID NO: 603823 - DNA, 498 bp, Homo sapiens; identical to SEQ ID NO: 535974
  misc_feature: HIJSMM301EUEMV.22.27.C05.1.454.light.4.raw

SEQ ID NO: 603824 - DNA, 497 bp, Homo sapiens; identical to SEQ ID NO: 535286
  misc_feature: HIJSMM301EKNT3.18.59.F04.1.454.light.4.raw

SEQ ID NO: 603825 - DNA, 502 bp, Homo sapiens
  misc_feature: HIJSMM301CO94B.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgctagtttattactgtcagcagcgtgccactttcggcggaggtgcctactttcggcggagggaccaaaatagaggtacaaacgaactgtggctgcacatctgtcttc

SEQ ID NO: 603826 - DNA, 521 bp, Homo sapiens; identical to SEQ ID NO: 539470
  misc_feature: HIJSMM301AZ5JB.27.23.C01.1.454.light.4.raw

SEQ ID NO: 603827 - DNA, 485 bp, Homo sapiens; identical to SEQ ID NO: 535880
  misc_feature: HIJSMM301CSIF2.7.75.G09.1.454.light.4.raw

SEQ ID NO: 603828 - DNA, 516 bp, Homo sapiens
  misc_feature: HIJSMM301D3VCR.40.14.B03.1.454.light.4.raw
tctagcgactcacgaccggtgctcgatttagtgtgagtagttccgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaaactcatgatttctgacgtcagtaagcggccctcaggggtccctgatcgcttctctggctccaagtctggcaacacggcctccctgaccgtctctgggctccaggctgaagatgaggctgattattactgctactcgtatgtaggcggcaacaattgggtcttcggcggagggaccaagctgaccgtctaggtcagcccaaggctgccccctggtcactctgttcccacct

SEQ ID NO: 603829 - DNA, 514 bp, Homo sapiens; identical to SEQ ID NO: 541418
  misc_feature: HIJSMM301BN3BA.17.33.C11.1.454.light.4.raw

SEQ ID NO: 603830 - DNA, 497 bp, Homo sapiens
  misc_feature: HIJSMM301AVB0X.52.60.F05.1.454.light.4.raw
cgcagtacgacacgaccggtgctcgatttagtacgtcatcagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggacactgagaggccctcagggatccctgagcgattctctggctccacctcagggacactagtcacgttgaccatcagtggagtccaggcagaggacgaggctgactaccactgtcaatcaacagacagcagtggttcttatgtcttcgcaactgggaccaaggtcaccgtcctaggtcagcccaaggcccaaccccactgtcta

SEQ ID NO: 603831 - DNA, 494 bp, Homo sapiens
  misc_feature: HIJSMM301ESJQT.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggtattttgcagtgtattactgtcagcagtatcataggtcaaacaccttcggccaagggacacgactggagataaaggaactgtggctgcaccatctgtcttcatcttccccg

SEQ ID NO: 603832 - DNA, 479 bp, Homo sapiens; identical to SEQ ID NO: 542895
  misc_feature: HIJSMM301C4AXA.40.59.F04.1.454.light.4.raw

SEQ ID NO: 603833 - DNA, 508 bp, Homo sapiens
  misc_feature: HIJSMM301CJB3F.10.27.C05.1.454.light.4.raw
catagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgccttctttcaaggttttcggcggtagggaccaggctgaccgtcctaagtcagccaaggctcgccccctcggt

SEQ ID NO: 603834 - DNA, 496 bp, Homo sapiens
  misc_feature: HIJSMM301BKS4Y.43.53.E09.1.454.light.4.raw
tgtgagtagtcacgaccggtgctcgatttagagagagtgtgttgggtttggggtggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaa

SEQ ID NO: 603835 - DNA, 512 bp, Homo sapiens
  misc_feature: HIJSMM301BKDY2.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttccgcctcctcgctacgtaga

SEQ ID NO: 603836 - DNA, 487 bp, Homo sapiens
  misc_feature: HIJSMM301BKZHH.4.59.F04.1.454.light.4.raw
agcactgtagcacgaccggtgctcgatttagtacacacacttaggggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcaccttctctggagataaattgggccataaatttgcttcctggtatcagcagaagccaggccagtcccctatactggtcatctatcaagataccaagcggccctcagggatccctgagcgattctctggctccaattctgggaacacagccactctgaccatcaccgggacccaggctgtagatgaggctgactattactgtcaggcgtgggacagcagcactgaggtgttcggcggagggccaagctgaccgtcctacgtcagcccaaggctgcccctc

SEQ ID NO: 603837 - DNA, 508 bp, Homo sapiens; identical to SEQ ID NO: 541017
  misc_feature: HIJSMM301C1TYP.17.33.C11.1.454.light.4.raw

SEQ ID NO: 603838 - DNA, 500 bp, Homo sapiens
  misc_feature: HIJSMM301AX0PO.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaacccca

SEQ ID NO: 603839 - DNA, 501 bp, Homo sapiens
  misc_feature: HIJSMM301EI1SD.15.25.C03.1.454.light.4.raw
tctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcccgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatcagcagagtggaggctgaggacgttggggtttattactgcatgcaaggtctacaaaccccgatcaccttcggccgaggacacgcctggagattaaacgaactgtggctgcaccatctgt

SEQ ID NO: 603840 - DNA, 497 bp, Homo sapiens; identical to SEQ ID NO: 536371
  misc_feature: HIJSMM301EW9Y2.16.78.H01.1.454.light.4.raw

SEQ ID NO: 603841 - DNA, 487 bp, Homo sapiens
  misc_feature: HIJSMM301E06OB.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcggtccaggggaccaaggtggaagtcaggcgaactgtggctgcaccatct

SEQ ID NO: 603842 - DNA, 492 bp, Homo sapiens
  misc_feature: HIJSMM301B20JY.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggtcggagggaccgaaggtggaggatcaaacgaacta

SEQ ID NO: 603843 - DNA, 480 bp, Homo sapiens; identical to SEQ ID NO: 555208
  misc_feature: HIJSMM301COCP8.21.25.C03.1.454.light.4.raw

SEQ ID NO: 603844 - DNA, 480 bp, Homo sapiens
  misc_feature: HIJSMM301DP7I3.11.11.A11.1.454.light.4.raw
cgagagataccacgaccggtgctcgatttagctacgactgcaggggcagcaatatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcaccccggagtcccctgaccgattcagtggcagcgggtctgggacagacttcactctcaccatcagcaacctgcaggctgaagatgtggcagtttattactgtcagcagtattgtgaagctccgctcactttcggcggagggaccgcggtggagatcagacgaactgtggctgcaccatctgtctt

SEQ ID NO: 603845 - DNA, 514 bp, Homo sapiens
  misc_feature: HIJSMM301B24QT.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgctagtttattactgtcaacatcgtaccgagtggccgtccggggcctactttcggccctcgggaccgaaggtggagatacaaacgaactgtggctgcaccatctcgtcttcta

SEQ ID NO: 603846 - DNA, 500 bp, Homo sapiens; identical to SEQ ID NO: 540836
  misc_feature: HIJSMM301DWXV8.3.10.A10.1.454.light.4.raw

SEQ ID NO: 603847 - DNA, 520 bp, Homo sapiens; identical to SEQ ID NO: 539176
  misc_feature: HIJSMM301EP29S.27.23.C01.1.454.light.4.raw

SEQ ID NO: 603848 - DNA, 480 bp, Homo sapiens
  misc_feature: HIJSMM301DIZAA.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggccaagggaccaaggtggaaatcaaacgaaactgtggctgcacc

SEQ ID NO: 603849 - DNA, 510 bp, Homo sapiens; identical to SEQ ID NO: 538614
  misc_feature: HIJSMM301CH8Y8.19.59.F04.1.454.light.4.raw

SEQ ID NO: 603850 - DNA, 507 bp, Homo sapiens; identical to SEQ ID NO: 542586
  misc_feature: HIJSMM301A48MK.8.33.C11.1.454.light.4.raw

SEQ ID NO: 603851 - DNA, 473 bp, Homo sapiens; identical to SEQ ID NO: 535262
  misc_feature: HIJSMM301C0DBZ.8.67.G01.1.454.light.4.raw

SEQ ID NO: 603852 - DNA, 499 bp, Homo sapiens
  misc_feature: HIJSMM301E32AT.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaaactgtggctgcaccactctgtt

SEQ ID NO: 603853 - DNA, 486 bp, Homo sapiens; identical to SEQ ID NO: 548935
  misc_feature: HIJSMM301EDQFJ.47.38.D05.1.454.light.4.raw

SEQ ID NO: 603854 - DNA, 367 bp, Homo sapiens
  misc_feature: HIJSMM301BMBU3.41.34.D01.1.454.light.4.raw
tctatactatcacgaccggtgctcgatttagatcgtctgtgttgggtttgggggagtcagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtcccatcaaggtttagcggcagtggatctgggacagaattcactctcacga

SEQ ID NO: 603855 - DNA, 490 bp, Homo sapiens
  misc_feature: HIJSMM301CX8LQ.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaaacagaaaccagggaaagcccctgacctcctgatctatgctgcatccggtttgcacagtggggtcccgtcaaggttcagtggcagtggatctgggacagatttcactctcaccgtcagcagtctgcaacctgaagattttgcaacttactactgtcaacagagttacagtaccccctcactttcggcggagggaccaaggcggagatcagacgaactgtggctgcaccatctgtcttcatt

SEQ ID NO: 603856 - DNA, 522 bp, Homo sapiens
  misc_feature: HIJSMM301B65ZO.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctccccccggacgttcggtccgaacgggaccgaacgggtaggaaagtacaacgacgaaaccgtagtggctggcaccaatctcgtcttctatcttcccgt

SEQ ID NO: 603857 - DNA, 493 bp, Homo sapiens
  misc_feature: HIJSMM301A9CED.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagtacactgatttcacactgaaaatcagcagggtggaggctgaggatgtcgggtttactactgcatgcagggtacactctggccgttcacgttttggccgaggggaccaacgtggatatcagacgaactgtggctgcta

SEQ ID NO: 603858 - DNA, 494 bp, Homo sapiens
  misc_feature: HIJSMM301C6RT2.43.10.A10.1.454.light.4.raw
tgtgagtagtcacgaccggtgctcgatttagcgtcgatctcaggggagctgtgggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcaaatactattatgccagctggtaccagcagaaaccaagacaggcccctatacttgtcatctatggtaaaaacaaccgaccctcagggatcccagaccgattctctggctccagctcaggcaacacagcttccttgaccatcactggggctcaggcggaagatgaggctgactattactgtaactcccgggacagcaatggtgacctatatgtcttcggaactgggaccaaggtcaccgtcctaggtcagcccaaggccaacccactgtca

SEQ ID NO: 603859 - DNA, 489 bp, Homo sapiens; identical to SEQ ID NO: 536663
  misc_feature: HIJSMM301CX5ZU.16.72.G06.1.454.light.4.raw

SEQ ID NO: 603860 - DNA, 499 bp, Homo sapiens
  misc_feature: HIJSMM301AON57.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccacggacagacggccaagatcacctgctctggagatgcattgccaaagcaatatgcttattggtaccaacaaaagaccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaataacttatctttatgtcttcggatcttggggaccacgggtcacccgtacccgttaggtcgacgccccgaaaggcc

SEQ ID NO: 603861 - DNA, 471 bp, Homo sapiens
  misc_feature: HIJSMM301BK0K1.13.76.G10.1.454.light.4.raw
tcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcacgtcctaagtcag

SEQ ID NO: 603862 - DNA, 484 bp, Homo sapiens; identical to SEQ ID NO: 535211
  misc_feature: HIJSMM301AO0NQ.47.46.E02.1.454.light.4.raw

SEQ ID NO: 603863 - DNA, 489 bp, Homo sapiens
  misc_feature: HIJSMM301EEM5D.51.79.H02.1.454.light.4.raw
cgatcgtatacacgaccggtgctcgatttagtgtcacacgaagggaaagggcagctcctggggctgctaatgctctgggtcccaggatgcactggggatgttgtggtgactcagtctcctctctccctgcccgtcacccttggacaggcggcctccatctcctgcaggtctagtcacagcctcctacacagtgatggaaacacctacttgacttggtttcagcagaggcctggccaatctccaaggcgccttatttataaggtttctaatcgggactttggggtcccagacagattcagcggcagtgggtcacgcactcacttcacactgaaaatcagcagggtggaggctgaggatttaggggtttattactgcatgcaaggtacacactggcctccgtacacttttggccaggggaccaagctcgagatcaaacgaactgtggctgcaccatctgtcttcatcttcccgccatctgatcgtagcact

SEQ ID NO: 603864 - DNA, 496 bp, Homo sapiens; identical to SEQ ID NO: 535109
  misc_feature: HIJSMM301D395M.16.78.H01.1.454.light.4.raw

SEQ ID NO: 603865 - DNA, 502 bp, Homo sapiens; identical to SEQ ID NO: 537816
  misc_feature: HIJSMM301DNNBM.19.78.H01.1.454.light.4.raw

SEQ ID NO: 603866 - DNA, 444 bp, Homo sapiens; identical to SEQ ID NO: 535192
  misc_feature: HIJSMM301C1FKW.5.9.A09.1.454.light.4.raw

SEQ ID NO: 603867 - DNA, 482 bp, Homo sapiens; identical to SEQ ID NO: 535920
  misc_feature: HIJSMM301CYN6L.19.71.G05.1.454.light.4.raw

SEQ ID NO: 603868 - DNA, 491 bp, Homo sapiens; identical to SEQ ID NO: 596671
  misc_feature: HIJSMM301DHR3E.16.73.G07.1.454.light.4.raw

SEQ ID NO: 603869 - DNA, 518 bp, Homo sapiens; identical to SEQ ID NO: 539372
  misc_feature: HIJSMM301D6ZPN.7.86.H09.1.454.light.4.raw

SEQ ID NO: 603870 - DNA, 479 bp, Homo sapiens
  misc_feature: HIJSMM301DM0EQ.4.54.E10.1.454.light.4.raw
agcactgtagcacgaccggtgctcgatttagatcgtagcagaacacacaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcagcatcacttgccgggcaagtcagagcattagctacttttttaagttggtatcagcagacaccagggaaagcccctaagctcctgatctatgctgcttccagtttgcaaagtggggtcccatcaaggttcagtggcagtggatctgggacagatttcactctcactgtcagcagtctgcaatttgaagtattttgctaacttacctactgtcaacagtagttttcagttatccccttggactttcggccaagggaccaaggtggaaatcaaacgaa

SEQ ID NO: 603871 - DNA, 488 bp, Homo sapiens; identical to SEQ ID NO: 543022
  misc_feature: HIJSMM301EK2TR.9.59.F04.1.454.light.4.raw

SEQ ID NO: 603872 - DNA, 498 bp, Homo sapiens
  misc_feature: HIJSMM301EVAKX.10.65.F10.1.454.light.4.raw
catagtagtgcacgaccggtgctcgatttagctacgctctaagggggcaggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactggggaaagcccctacactcctgatcaatgcagcgtccagtttacagagtcggggtcccctcaaggttcagtggcagtggatctgggacagactttactctcaccatcagcgatctgcagcctgacgattttgcgacttactactgtcaacagagtttccggaacccgttacttcggcggagggaccaaggtggagatcaaacgaactgtggctgcaccatctgtcttcatcttccccg

SEQ ID NO: 603873 - DNA, 494 bp, Homo sapiens
  misc_feature: HIJSMM301A3FNS.40.53.E09.1.454.light.4.raw
tctagcgactcacgaccggtgctcgatttagagagagtgtgttgggtttgggcacgaccggtgctcgatttagagagagtgtgttgggtttgggggccgttcctgggcccagtctgtgctgactcagccaccctcagcgtctgggacccccggtcagagggtcaccatctcttgttctggaagcagatccaacatcggaagtaatactgtaaactggtaccagcagctcccaggaacggcccccaaactcctcatctatgataatagtcaccggccctcaggggtacctgaccgattctctggctccaagtctggcacctcagcctccctggccatcagtgggctccagtctgaggatgaggctgattatcactgtgcatcctgggatgacagcctgaatggttgggtgttcggcgggggaccaagctgaccgtcctaagtcagcccaaggctgccccctcggtcactctgttcccgccctcctcatcgctaga

SEQ ID NO: 603874 - DNA, 481 bp, Homo sapiens; identical to SEQ ID NO: 545234
  misc_feature: HIJSMM301CY76Z.49.50.E06.1.454.light.4.raw

SEQ ID NO: 603875 - DNA, 486 bp, Homo sapiens; identical to SEQ ID NO: 536261
  misc_feature: HIJSMM301EOSVB.26.55.E11.1.454.light.4.raw

SEQ ID NO: 603876 - DNA, 485 bp, Homo sapiens; identical to SEQ ID NO: 538533
  misc_feature: HIJSMM301CT2O0.47.78.H01.1.454.light.4.raw

SEQ ID NO: 603877 - DNA, 502 bp, Homo sapiens
  misc_feature: HIJSMM301BW6B6.3.21.B10.1.454.light.4.raw
agacgcactccacgaccggtgctcgatttagtgtcgtcgcaagagaggagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggaccaggcccctgtacttgttcatctatggtaaaaacaccggccctcagggatcccagaccgattctctggctccagctcaggaaacacagcttccttgaccatcactggggctcaggcggaagatgaggctgactattactgtaacctcccgggccagccagtggtaacattgtgatattcggcggaggggaccaaggtgaccgtcctacgtcagccaaggctgccccctcggtccactctcg

SEQ ID NO: 603878 - DNA, 494 bp, Homo sapiens
  misc_feature: HIJSMM301C2L2I.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttccaccctcaccatcaatagcctggaagctgaagatgctgcaacttattactgtcatcagagtactactttacctcaagtgatcaccttcggccaagggacacgactggagattaaacgaactgtggctgcacatctgtctt

SEQ ID NO: 603879 - DNA, 486 bp, Homo sapiens; identical to SEQ ID NO: 535043
  misc_feature: HIJSMM301DPM82.46.35.D02.1.454.light.4.raw

SEQ ID NO: 603880 - DNA, 488 bp, Homo sapiens
  misc_feature: HIJSMM301CSENN.48.19.B08.1.454.light.4.raw
agtatacatacacgaccggtgctcgatttagtgagtcagtaagggagaagggcttgatgccttggggtgggaggagagacccctcccctgggatcctgcagctctagtctcccgtggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgct

SEQ ID NO: 603881 - DNA, 503 bp, Homo sapiens
  misc_feature: HIJSMM301C23MU.10.82.H05.1.454.light.4.raw
catagtagtgcacgaccggtgctcgatttagtcgagctctctcgcgggggcttcagctgtgagcgcagaaggcaggactcgggacaatcttcatcatgacctgctcccctctcctcctcacccttctcattcactgcacagggtcctgggcccagtctgtattgacgcagccgccctcagtgtctgcggccccaggacagaaggtcaccatctcctgctctggaggcagttccaacattgggaattcttatgtttcctggtaccagcacatcccaggaggtgcccccaaactcctcatatatgaagatgataagcgaccgtcagggattcctgaccgattctctggctccaagtctggcacgtcggccaccctgggcatcgccggactccagactggggacgaggccgattttactgcggaacatgggataccagcctgcatggtgtggttttcggcggagggaccaagctgaccgtcctaagtcagcccaaggctgcccccc

SEQ ID NO: 603882 - DNA, 484 bp, Homo sapiens; identical to SEQ ID NO: 538870
  misc_feature: HIJSMM301DI69U.11.76.G10.1.454.light.4.raw

SEQ ID NO: 603883 - DNA, 485 bp, Homo sapiens
  misc_feature: HIJSMM301CPY29.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtggctgcaccatctgtct

SEQ ID NO: 603884 - DNA, 511 bp, Homo sapiens
  misc_feature: HIJSMM301EGB03.48.32.C10.1.454.light.4.raw
agtatacatacacgaccggtgctcgatttagtatagacatcaacacacaaagggggtagctcaggaagcagagcctggagcatctccactatggcctggactccactacttctcaccctcctcgctcactgcacaggttcttgggccacttttaaactgactcagccccactccgtgtcggggtctccggggaagacggtaagcatcacctgcacccgcaccagtggcgacattgccagcaactttgtgcagtgggtccagcagcgcccgggccgttcccccgccactgtaatatatgaggacattcaaagaccttctggggtccctcctcgattctctggctccatcgacaggtcctccaactccgcctccctcttcatctctgaactgaagactgaggacgaggctgcttattactgtcagtcctctgatggcagcgcagttgtcttcggcggagggaccacactgaccgttatcggtcagcccaaggctgccccctcggtcactctcg

SEQ ID NO: 603885 - DNA, 492 bp, Homo sapiens; identical to SEQ ID NO: 552746
  misc_feature: HIJSMM301EJZM8.21.9.A09.1.454.light.4.raw

SEQ ID NO: 603886 - DNA, 480 bp, Homo sapiens
  misc_feature: HIJSMM301CUXZS.12.10.A10.1.454.light.4.raw
atacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaaagcccctaacgtcctgatctatggtgcatccactttgcatagtggggtcccatctaaggttcagcggcagtggatctgggacagaattcactctcacaatcaccagcctgcagcctgaagattttgcaacttattactgtcaacaggtttatatttaccctcgtattttcggccctgggaccacagtagatatcaaacgaactgtggctgcacc

SEQ ID NO: 603887 - DNA, 476 bp, Homo sapiens; identical to SEQ ID NO: 538026
  misc_feature: HIJSMM301D3FKO.13.76.G10.1.454.light.4.raw

SEQ ID NO: 603888 - DNA, 501 bp, Homo sapiens; identical to SEQ ID NO: 535746
  misc_feature: HIJSMM301D2ECH.18.11.A11.1.454.light.4.raw

SEQ ID NO: 603889 - DNA, 509 bp, Homo sapiens; identical to SEQ ID NO: 579512
  misc_feature: HIJSMM301BIFA5.8.33.C11.1.454.light.4.raw

SEQ ID NO: 603890 - DNA, 489 bp, Homo sapiens
  misc_feature: HIJSMM301D8GGN.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgaggcggccgaccaagtcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 603891 - DNA, 505 bp, Homo sapiens; identical to SEQ ID NO: 535503
  misc_feature: HIJSMM301CF7KM.8.28.C06.1.454.light.4.raw

SEQ ID NO: 603892 - DNA, 489 bp, Homo sapiens; identical to SEQ ID NO: 535139
  misc_feature: HIJSMM301A9H9Z.14.55.E11.1.454.light.4.raw

SEQ ID NO: 603893 - DNA, 509 bp, Homo sapiens
  misc_feature: HIJSMM301AKHKR.11.75.G09.1.454.light.4.raw
cgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcaggggtccctgaccggttctctggctccaagtctggctcttccgcctccttggccatcactgggctcgaggctgacgatgaggctgattactactgtctgtcctatgacgacgacctacagactccggttttcggtcggagggactaagctgaccgtcctaagtcagcccaaggctgccccctcggtcactctcgttcccta

SEQ ID NO: 603894 - DNA, 501 bp, Homo sapiens
  misc_feature: HIJSMM301CXZZR.12.67.G01.1.454.light.4.raw
atacgacgtacacgaccggtgctcgatttagagtatacatattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcagagcccccaaactcatgatttttgatgtcactaatcggccctcaggggtttctgatcgcttctctggctccaagtctgactacacggcctccctgaccatctctgggctccaggctgaggacgaggctgattattattgcagctcatatacaagcagcagcaccctctttgtcttcggaagtgggaccaaggtcaccgtcctacgtcagcccaaggccaaccc

SEQ ID NO: 603895 - DNA, 492 bp, Homo sapiens; identical to SEQ ID NO: 537395
  misc_feature: HIJSMM301A0BUM.16.73.G07.1.454.light.4.raw

SEQ ID NO: 603896 - DNA, 501 bp, Homo sapiens; identical to SEQ ID NO: 535746
  misc_feature: HIJSMM301DT4O3.18.11.A11.1.454.light.4.raw

SEQ ID NO: 603897 - DNA, 495 bp, Homo sapiens; identical to SEQ ID NO: 535143
  misc_feature: HIJSMM301DXOKD.51.29.C07.1.454.light.4.raw

SEQ ID NO: 603898 - DNA, 500 bp, Homo sapiens
  misc_feature: HIJSMM301DZD46.19.67.G01.1.454.light.4.raw
tactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagtttatactgtcagcaatattttctatcctccgtggacgttcggccaagggaccagggtggaaatcagacgaactgtgctgcaccat

SEQ ID NO: 603899 - DNA, 498 bp, Homo sapiens
  misc_feature: HIJSMM301BFD4G.48.35.D02.1.454.light.4.raw
agtatacatacacgaccggtgctcgatttagcacacgatagttgggtttgggaggagagacccctcccctgggatcctgcagctctagtctcccgtggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctcaagtctggcaacacggcctccctgaccgtctctgggctccaggctgaggatgaggctgatttattactgcagctcatatgcaggcagcaacaatgtggtattc

SEQ ID NO: 603900 - DNA, 495 bp, Homo sapiens
  misc_feature: HIJSMM301BXUY5.52.82.H05.1.454.light.4.raw
cgcagtacgacacgaccggtgctcgatttagtcgagctctctcgcgggcacgaccggtgctcgatttagagtgagctcgttgggttcgggggtgggtccaggaggcagaactctgggtgtctcaccatggcctggatccctctacttcctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatatataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgccgacctaac

SEQ ID NO: 603901 - DNA, 498 bp, Homo sapiens
  misc_feature: HIJSMM301EBWP2.11.81.H04.1.454.light.4.raw
cgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgccccagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgctagtttttactgtcagcagtatagtaactggcctccgtacacttttggccaggggaccaagctagaaatcaaacgaactgtggctgcaccatctgtcttcta

SEQ ID NO: 603902 - DNA, 494 bp, Homo sapiens
  misc_feature: HIJSMM301CD5UU.17.25.C03.1.454.light.4.raw
cgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacacgttcccctcgctacttttcggccgaggggaccaaagttgagatacaaacgaactgtggctgcaccatctgtt

SEQ ID NO: 603903 - DNA, 503 bp, Homo sapiens; identical to SEQ ID NO: 537189
  misc_feature: HIJSMM301B9097.19.85.H08.1.454.light.4.raw

SEQ ID NO: 603904 - DNA, 509 bp, Homo sapiens; identical to SEQ ID NO: 535670
  misc_feature: HIJSMM301B8RH6.47.23.C01.1.454.light.4.raw

SEQ ID NO: 603905 - DNA, 507 bp, Homo sapiens; identical to SEQ ID NO: 535641
  misc_feature: HIJSMM301DLNNL.10.88.H11.1.454.light.4.raw

SEQ ID NO: 603906 - DNA, 460 bp, Homo sapiens; identical to SEQ ID NO: 536053
  misc_feature: HIJSMM301B3XRB.22.28.C06.1.454.light.4.raw

SEQ ID NO: 603907 - DNA, 494 bp, Homo sapiens
  misc_feature: HIJSMM301DYO6K.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagattacaattaccctcggacgttcggtccacgggaccgaacggtaggaaagtacaaacgaactagtggcgtgcacc

SEQ ID NO: 603908 - DNA, 497 bp, Homo sapiens; identical to SEQ ID NO: 577310
  misc_feature: HIJSMM301DSZR3.3.33.C11.1.454.light.4.raw

SEQ ID NO: 603909 - DNA, 502 bp, Homo sapiens; identical to SEQ ID NO: 598841
  misc_feature: HIJSMM301CRJ1H.48.41.D08.1.454.light.4.raw

SEQ ID NO: 603910 - DNA, 481 bp, Homo sapiens; identical to SEQ ID NO: 535993
  misc_feature: HIJSMM301E2MM4.21.25.C03.1.454.light.4.raw

SEQ ID NO: 603911 - DNA, 493 bp, Homo sapiens
  misc_feature: HIJSMM301DR48O.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcagggtggaggctgaggatgttgggtttgttcctccatgcaaggtacacactggccttttggccaggggaccaacctcggagatcaaatgaactgtggctgcaccatctgtctt

SEQ ID NO: 603912 - DNA, 459 bp, Homo sapiens
  misc_feature: HIJSMM301D6N9Z.11.86.H09.1.454.light.4.raw
cgagagataccacgaccggtgctcgatttagtgctatagacttgggtttgggggccgttcctgggcccagactgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcagcatgggatgacaccctgaatggtccttgtgtggttttcggcggagggaccaagctgaccgtcctaggtcagcccaaggctgccccctcggtcactctgttcccgcctcctcgtatctctcg

SEQ ID NO: 603913 - DNA, 516 bp, Homo sapiens
  misc_feature: HIJSMM301EK1MB.22.30.C08.1.454.light.4.raw
  modified_base (499)..(499): a, c, t, g, unknown or other
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgacgtcctaggtcagcccaaggctgccccctggtccactcngttcccacctcctcacg

SEQ ID NO: 603914 - DNA, 486 bp, Homo sapiens; identical to SEQ ID NO: 535043
  misc_feature: HIJSMM301DCOK2.46.35.D02.1.454.light.4.raw

SEQ ID NO: 603915 - DNA, 480 bp, Homo sapiens
  misc_feature: HIJSMM301AYZX1.11.17.B06.1.454.light.4.raw
cgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgctaacttactactgtcaacagagttacagtaccccgtggacgttcggccaagggaccaaggtaggaaatacaacgaactagtggctgca

SEQ ID NO: 603916 - DNA, 508 bp, Homo sapiens; identical to SEQ ID NO: 549157
  misc_feature: HIJSMM301D2OJT.17.33.C11.1.454.light.4.raw

SEQ ID NO: 603917 - DNA, 445 bp, Homo sapiens
  misc_feature: HIJSMM301D0G77.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgtttcccaccctcctcgacacgcgag

SEQ ID NO: 603918 - DNA, 487 bp, Homo sapiens; identical to SEQ ID NO: 545757
  misc_feature: HIJSMM301BMM4H.49.3.A03.1.454.light.4.raw

SEQ ID NO: 603919 - DNA, 494 bp, Homo sapiens; identical to SEQ ID NO: 534992
  misc_feature: HIJSMM301E10SS.9.1.A01.1.454.light.4.raw

SEQ ID NO: 603920 - DNA, 493 bp, Homo sapiens
  misc_feature: HIJSMM301BO0U1.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagttttattactgtcagcaatactatagtcctcctctcacgttcggcggagggaccaaggtggagatcaaacgaactgtggctgcacatctgtcttcatccttcccgccat

SEQ ID NO: 603921 - DNA, 513 bp, Homo sapiens; identical to SEQ ID NO: 545752
  misc_feature: HIJSMM301D1WN2.17.33.C11.1.454.light.4.raw

SEQ ID NO: 603922 - DNA, 495 bp, Homo sapiens
  misc_feature: HIJSMM301BVCSQ.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaacgggacacgactggagattaaacgaactgtggctgcaccatctgtctt

SEQ ID NO: 603923 - DNA, 503 bp, Homo sapiens; identical to SEQ ID NO: 547049
  misc_feature: HIJSMM301ESRHE.18.59.F04.1.454.light.4.raw

SEQ ID NO: 603924 - DNA, 503 bp, Homo sapiens
  misc_feature: HIJSMM301AQXMT.51.10.A10.1.454.light.4.raw
cgatcgtatacacgaccggtgctcgatttagcgtcgatctcaggggcagcttcagctgtgggtagagaagacaggactcaggacaatctccagcatggccagcttccctctcctcctcaccctcctcactcactgtgcagggtcctgggcccaatctgtgctgactcagccaccctcagcgtctgggacccccgggcagagggtcaccatctcctgttctggaagcaactccaacatcggaagttatactgcagactggtaccagcaactcccaggatcggcccccaaactcctcatctatactactaatcaacgggccacaggggtccctgaccgattctccggctccaagtctggcacctcagcctccctggccatcagtggtctccagtctgaggatgaggctcaatacttctgtgcatcatgggatgacagtttgaatggtccggtgttcggcggagggaccaaactgaccgtccttagtcagcccaaggctgcccccc

SEQ ID NO: 603925 - DNA, 486 bp, Homo sapiens
  misc_feature: HIJSMM301BARW3.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcatacgaactgtggctgcatcatctgtctt

SEQ ID NO: 603926 - DNA, 488 bp, Homo sapiens; identical to SEQ ID NO: 538628
  misc_feature: HIJSMM301CP9JQ.40.8.A08.1.454.light.4.raw

SEQ ID NO: 603927 - DNA, 491 bp, Homo sapiens
  misc_feature: HIJSMM301BS5O7.27.78.H01.1.454.light.4.raw
agcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcaccatct

SEQ ID NO: 603928 - DNA, 516 bp, Homo sapiens
  misc_feature: HIJSMM301BIKRY.22.36.D03.1.454.light.4.raw
  modified_base (512)..(512): a, c, t, g, unknown or other
acatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaacccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaattaggcgccactctcgtggttttcggcggaggcaccgaagtgaccgtcctcggtcagcccaaggctgccccctcggtacnctcg

SEQ ID NO: 603929 - DNA, 497 bp, Homo sapiens
  misc_feature: HIJSMM301DPHBD.40.57.F02.1.454.light.4.raw
tctagcgactcacgaccggtgctcgatttagctcgatatagttgggtttggggtggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttatttttgctgctcttatgcaggcagtttcgctctcgaagtgttcggcggagggaccgagctgaccgtcctacgtcagcccaaggcc

SEQ ID NO: 603930 - DNA, 486 bp, Homo sapiens
  misc_feature: HIJSMM301DOVZX.12.31.C09.1.454.light.4.raw
  modified_base (364)..(364): a, c, t, g, unknown or other
atacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccacgtatttaaattggtatcaacaaaagcaggcaaagtcccaaagctcctgatttatgctgccaccagtctgcaaggtggttcccgtcaaggttcactggccgtggatcagggacagaatttacnctcaccatcagtagtctacagcctgaagatattgctacttattactgtcagcagagttaccgcgctcccatcactttcggccaagggacacgaccgcagattggacgaactgtggctgcacc

SEQ ID NO: 603931 - DNA, 494 bp, Homo sapiens
  misc_feature: HIJSMM301AYZJU.15.26.C04.1.454.light.4.raw
tctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaagcccctaacctcctaatctatgatgcctccagtttggagagtggggtcccatctaggttcagcggcagtggatttgggacagaattcactctcaccatccgcagcctgcagcctgaagatttgcaacttattactgccaacagtataatagcaattctccgtggacgttcggccaagggaccagggtggatatcaaacgaactagtggctgcaccatctgtcttcat

SEQ ID NO: 603932 - DNA, 492 bp, Homo sapiens; identical to SEQ ID NO: 536087
  misc_feature: HIJSMM301AYJOB.10.17.B06.1.454.light.4.raw

SEQ ID NO: 603933 - DNA, 493 bp, Homo sapiens; identical to SEQ ID NO: 536246
  misc_feature: HIJSMM301EJ2W8.49.66.F11.1.454.light.4.raw

SEQ ID NO: 603934 - DNA, 488 bp, Homo sapiens
  misc_feature: HIJSMM301B4RH0.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccgaggggaccaagctggagatacaaacgaactgtggctgcaccat

SEQ ID NO: 603935 - DNA, 497 bp, Homo sapiens
  misc_feature: HIJSMM301BLPHQ.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactgcctcggacgtcggccaaggaccgaaacgtaggacgatacaagacgaacctagtggcgtcgcaccactact

SEQ ID NO: 603936 - DNA, 490 bp, Homo sapiens; identical to SEQ ID NO: 551557
  misc_feature: HIJSMM301DEBC8.48.75.G09.1.454.light.4.raw

SEQ ID NO: 603937 - DNA, 496 bp, Homo sapiens
  misc_feature: HIJSMM301C35QR.40.71.G05.1.454.light.4.raw
tctagcgactcacgaccggtgctcgatttagtgtcgtcgcaagagagagggggaagctctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccgggacagaaggtcaccatctcctgctctggaagcagctccaacattgggaaaaattatgtatcctggtaccagcagctcccaggaacagcccccaaactcctcatttatgacaataataagcgaccctcagggattcctgaccgattctctggctccaagtctggcacgtcagccaccctgggcatcaccggactccagactggcgacgaggccgtttattattgcggaacatgggataggcggcctgagtgatgagtggatggttcggcggcgggaccaaactgaccgtct

SEQ ID NO: 603938 - DNA, 496 bp, Homo sapiens
  misc_feature: HIJSMM301EJLD4.52.35.D02.1.454.light.4.raw
cgcagtacgacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcactc

SEQ ID NO: 603939 - DNA, 514 bp, Homo sapiens
  misc_feature: HIJSMM301BGSI1.43.81.H04.1.454.light.4.raw
tgtgagtagtcacgaccggtgctcgatttagtagtgtagattcgcgggcacgaccggtgctcgatttagtagtgtagattcgcggggtctggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttggggcaaagctgccctgacactgtcaggtgtgcaccctgaggacgaggctgagtattactgtctgctccactttcgtactgcctgggtcttcggcgggggactcagttgaccgtcctaggtcagcccaa

SEQ ID NO: 603940 - DNA, 521 bp, Homo sapiens
  misc_feature: HIJSMM301CB6NI.13.38.D05.1.454.light.4.raw
tcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcagggtctacagcctgaagattttgcgtacttactattgtcaacagagttaccttctcccccggacgttcgtccgacggaccgaacggtaggaagtacgaagacgaacgtagtcggcgtcgcgaccaactacctcgtcttctactcttcccgt

SEQ ID NO: 603941 - DNA, 500 bp, Homo sapiens
  misc_feature: HIJSMM301AL4I4.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcgggcgggagggaccaaggtgaccgtcctacgtcagcccaaggctcgccccctcggtcactctcg

SEQ ID NO: 603942 - DNA, 503 bp, Homo sapiens; identical to SEQ ID NO: 576321
  misc_feature: HIJSMM301CH4TN.17.28.C06.1.454.light.4.raw

SEQ ID NO: 603943 - DNA, 505 bp, Homo sapiens
  misc_feature: HIJSMM301BVOZP.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcaggtgggtctgggacagacttcactctcaccatcagcagcctagacgcctgaagtactttggtacttttattactgtcagcagcgtgagttctggcctccgctctactttcggcggacggggaccgaggggtggagatacgaaaacgaacgtgtggctcgcaccatctgtcttc

SEQ ID NO: 603944 - DNA, 493 bp, Homo sapiens; identical to SEQ ID NO: 535745
  misc_feature: HIJSMM301ANXKK.47.78.H01.1.454.light.4.raw

SEQ ID NO: 603945 - DNA, 500 bp, Homo sapiens
  misc_feature: HIJSMM301DG320.40.57.F02.1.454.light.4.raw
tctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaacctagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttatttttgtctgctcttatgcaggcagtttcgctctcgaagtgttcggcggagggaccgagctgaccgtcctacgtcagcccaaggctcg

SEQ ID NO: 603946 - DNA, 484 bp, Homo sapiens; identical to SEQ ID NO: 535240
  misc_feature: HIJSMM301D2HWH.47.60.F05.1.454.light.4.raw

SEQ ID NO: 603947 - DNA, 486 bp, Homo sapiens; identical to SEQ ID NO: 536261
  misc_feature: HIJSMM301CUWDD.26.55.E11.1.454.light.4.raw

SEQ ID NO: 603948 - DNA, 384 bp, Homo sapiens
  misc_feature: HIJSMM301BL37R.41.33.C11.1.454.light.4.raw
tctatactatcacgaccggtgctcgatttagagtgagctcgttgggtttgggggaaagagccaccctctcctgcagggccagtgagacagttactgtcaattacttagcctggtaccagcagaagcctggccaggctcccaggctcctcatctctgctgccttcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 603949 - DNA, 512 bp, Homo sapiens; identical to SEQ ID NO: 563627
  misc_feature: HIJSMM301ETRTA.43.59.F04.1.454.light.4.raw

SEQ ID NO: 603950 - DNA, 355 bp, Homo sapiens
  misc_feature: HIJSMM301EEOQB.19.22.B11.1.454.light.4.raw
tactctcgtgcacgaccggtgctcgatttagacgacagctcagggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatattttatacaactccaataataagaactacttagcttggttccagcagaaaccaggacagcctcctaagatgctcttttattgggcatctgcccgggaatccggggtccctgaccgattcagtggcagcgggtctgggacagatttcactctcacca

SEQ ID NO: 603951 - DNA, 501 bp, Homo sapiens
  misc_feature: HIJSMM301AVM57.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaagtggatatcaaacgaactagtggctgcaccatct

SEQ ID NO: 603952 - DNA, 461 bp, Homo sapiens
  misc_feature: HIJSMM301BQACZ.11.86.H09.1.454.light.4.raw
cgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgttgcagcatgggatgacaccctgaatggtccttgtgtggttttcggcggagggaccaagctgaccgtcctaggtcagcccaaggctgccccctcggtcactctgttcccaccctcctcgtatctctcg

SEQ ID NO: 603953 - DNA, 496 bp, Homo sapiens; identical to SEQ ID NO: 560353
  misc_feature: HIJSMM301B1SNJ.43.16.B05.1.454.light.4.raw

SEQ ID NO: 603954 - DNA, 489 bp, Homo sapiens; identical to SEQ ID NO: 568239
  misc_feature: HIJSMM301DBIBP.11.28.C06.1.454.light.4.raw

SEQ ID NO: 603955 - DNA, 489 bp, Homo sapiens
  misc_feature: HIJSMM301CT5EV.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtacccatcaaggttcagtggcgccggatctgggacagaattcactctcaccatcagcgggctccagtctgaggactctgcaacttattactgccaacaatatgatatttattctccagcgttcggccaggggaccaaggtggaagtcaagcgaactgtggctgcacatctgtt

SEQ ID NO: 603956 - DNA, 499 bp, Homo sapiens
  misc_feature: HIJSMM301CNHE1.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctcctgacaatctctgggctccaggctgacgacgaggctaattattactgctgctcatatgaaggtttataacactatactattcggcggagggaccaagctgaccgtcctgcgtcagcccaaggctgccccatcggtca

SEQ ID NO: 603957 - DNA, 504 bp, Homo sapiens
  misc_feature: HIJSMM301ATK5F.14.57.F02.1.454.light.4.raw
cgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggccgctcactttcggcggggggaccgaaggtggagttcaaacgaactagtggctgcaccatctgtcttcatcttctcg

SEQ ID NO: 603958 - DNA, 521 bp, Homo sapiens; identical to SEQ ID NO: 539470
  misc_feature: HIJSMM301CUUH9.27.23.C01.1.454.light.4.raw

SEQ ID NO: 603959 - DNA, 484 bp, Homo sapiens; identical to SEQ ID NO: 537689
  misc_feature: HIJSMM301D26WY.19.71.G05.1.454.light.4.raw

SEQ ID NO: 603960 - DNA, 505 bp, Homo sapiens
  misc_feature: HIJSMM301CG64X.47.85.H08.1.454.light.4.raw
agctcacgtacacgaccggtgctcgatttagtatcactcagtcgcgggggctggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagccaaggctgccccctcggtcact

SEQ ID NO: 603961 - DNA, 492 bp, Homo sapiens; identical to SEQ ID NO: 536087
  misc_feature: HIJSMM301ADRB0.10.17.B06.1.454.light.4.raw

SEQ ID NO: 603962 - DNA, 502 bp, Homo sapiens
  misc_feature: HIJSMM301DHUB2.51.2.A02.1.454.light.4.raw
cgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattacctgtgggggaaacaacattggaagtaaactgtgcactggtaccagcagaagccaggccaggcccctgtgctggtcgtctatgatgatgccgaccggccctcagggatccctgaacgattctctggctccagctctgagaacacggccaccctgagcatcagcagggtcgaagccggggatgaggccgactattactgtcaggtgtgggatactagtagtgatcatgtcttcggacctgggaccaaggtcaccgtcctaggtcagcccaaggccaacccactgtcactctgttcccgccct

SEQ ID NO: 603963 - DNA, 497 bp, Homo sapiens; identical to SEQ ID NO: 535740
  misc_feature: HIJSMM301EZ95C.3.71.G05.1.454.light.4.raw

SEQ ID NO: 603964 - DNA, 483 bp, Homo sapiens
  misc_feature: HIJSMM301ENZ0C.41.68.G02.1.454.light.4.raw
tctatactatcacgaccggtgctcgatttagtcgatagtgaagggaaagggggagtcagtcccaaccaggacacagcatggacatgagggtccctgctcagctcctggggctcctgctgctctggctctcaggtgccagatgtgacatccagatgacccagtctccaacctccctgtctgcatctgtaggagacagagtcaccatcacttgccaggccagtcaggacattagcaactatttaaattggtatcagcagaaaccagggaaagcccctaagctcctgatctacgatgcatccaatttggaatcaggggtcccatcaaggttcagtggaagtggatctgggacagattttactttctaccatcaccagcctgcagcctgaagatattgcaacatattactgtcaacagtatgataatctccctcccactttcggcggagggaccaaggtggaggatcaaacgaactgtggctgcacc

SEQ ID NO: 603965 - DNA, 492 bp, Homo sapiens
  misc_feature: HIJSMM301DL9L3.51.71.G05.1.454.light.4.raw
cgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagccaaggccaacccactgtca

SEQ ID NO: 603966 - DNA, 512 bp, Homo sapiens; identical to SEQ ID NO: 562621
  misc_feature: HIJSMM301DNJL6.7.34.D01.1.454.light.4.raw

SEQ ID NO: 603967 - DNA, 460 bp, Homo sapiens; identical to SEQ ID NO: 539553
  misc_feature: HIJSMM301AX8LC.11.86.H09.1.454.light.4.raw

SEQ ID NO: 603968 - DNA, 485 bp, Homo sapiens; identical to SEQ ID NO: 539299
  misc_feature: HIJSMM301BYZY9.3.10.A10.1.454.light.4.raw

SEQ ID NO: 603969 - DNA, 487 bp, Homo sapiens; identical to SEQ ID NO: 536206
  misc_feature: HIJSMM301AXHL9.47.38.D05.1.454.light.4.raw

SEQ ID NO: 603970 - DNA, 501 bp, Homo sapiens
  misc_feature: HIJSMM301ECOOW.11.21.B10.1.454.light.4.raw
cgagagataccacgaccggtgctcgatttagtgtcgtcgcaaggagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaacagaaacctggccagactcccaggctcctcatctatgatgcatccaacagggccactggcaccccagccaggttcagtggcagtgggtctgggacagacttcactctcaccatcagcagcctagagcctgaggattttgctagtttattactgtcagcagcgtatcgactggatcaccttcggccaagggacacgactggaaattaaacgaactgtggctgcaccatctgtcttcatcttccccg

SEQ ID NO: 603971 - DNA, 495 bp, Homo sapiens
  misc_feature: HIJSMM301C70VN.10.36.D03.1.454.light.4.raw
catagtagtgcacgaccggtgctcgatttagctgcgtcacgagtctctcttggggagagaagacaggattcaggacaatctccagcatggccggcttccctctcctcctcaccctcctcactcactgtgcagggtcctgggcccagtctgtgctgactcagccaccctcagcgtctgggacccccaggcagagggtcaccatctcttgttctggaagcagctccaatgtcgggagagataatgtgtactggtaccagcaggtcccaggaacggcacccaaactcctcatctataacgattatcggcggccctcaggggtccctgaccgattctctggctccaagtctggcacctcagcctccctggccatcagtgggctccgggtccgaggatgacgctgattattactgtgtagcatgggatgacagcctgagtgcttatgtcttaggaactgggaccaaggtcaccgtcctacgtcagcccaaggccaaccca

SEQ ID NO: 603972 - DNA, 489 bp, Homo sapiens
  misc_feature: HIJSMM301BLFNI.4.59.F04.1.454.light.4.raw
agcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcaccttctctggagataaattgggccataaatttgcttcctggtatcagcagaagccaggccagtcccctatactggtcatctatcaagataccaagcggccctcagggatccctgagcgattctctggctccaattctgggaacacagccactctgaccatcaccgggacccaggctgtagatgaggctgactattactgtcaggcgtgggacagcagcaactgaggtgttcggcggagggaccaagctgaccgtcctacgtcagcccaaggctgccccctc

SEQ ID NO: 603973 - DNA, 484 bp, Homo sapiens
  misc_feature: HIJSMM301ASVHD.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttatactgccaacaatatgatatttattctcagcgttcggccaggggaccaaggtggaagtcaagcgaactgtggctgcaccatct

SEQ ID NO: 603974 - DNA, 515 bp, Homo sapiens
  misc_feature: HIJSMM301CEDDW.48.34.D01.1.454.light.4.raw
agtatacatacacgaccggtgctcgatttagatcgtctgtgttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcacgcccaaggctcgccccctcggtcactctcgttcccaccct

SEQ ID NO: 603975 - DNA, 493 bp, Homo sapiens; identical to SEQ ID NO: 535199
  misc_feature: HIJSMM301BMY7Q.16.86.H09.1.454.light.4.raw

SEQ ID NO: 603976 - DNA, 501 bp, Homo sapiens
  misc_feature: HIJSMM301BSYNW.43.15.B04.1.454.light.4.raw
tgtgagtagtcacgaccggtgctcgatttagacagtatatatccgcgggggaggaactgctcagttaggacccagacggaaccatggaagccccagcgcagcttctcttcctcctgctactctggctcccagaaaccactggagaaatagtgatgacgcagtctccagccaccctgtctttgtctccaggggaaagagccaccctctcatgcagggccagtcagagtgttagcaccaacgtggcctggtaccagcagaaacctggccagcctccccggctcctcatctctggtgcatcctccagggccactggttccccagccaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttccccg

SEQ ID NO: 603977 - DNA, 499 bp, Homo sapiens; identical to SEQ ID NO: 538774
  misc_feature: HIJSMM301AYGOP.26.26.C04.1.454.light.4.raw

SEQ ID NO: 603978 - DNA, 489 bp, Homo sapiens
  misc_feature: HIJSMM301BVIDD.49.20.B09.1.454.light.4.raw
agtcgagagacacgaccggtgctcgatttagtgtagtgtgaagggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacaatatgcttactggtaccagcagaggccaggccaggcccctgtcttggtgatttataaagactttgagaggccctcagggacccctgagcgattctctggctccagctcagggacaacagtcaccttgaccatcagtggagtccggccagaggacgaggctgactattactgtcagtccgcagacagcagtggcagttatgtcgtattcggcggagggactacgctgaccgtcctaggtcagcccaaggctgcccctcggtcactctcg

SEQ ID NO: 603979 - DNA, 505 bp, Homo sapiens
  misc_feature: HIJSMM301BHULA.19.67.G01.1.454.light.4.raw
tactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagttttattactgtcagcaatatttttcttatcctccgtggacgttcggccaagggaccagggtggaaatcagacgaactgtggctgcaccat

SEQ ID NO: 603980 - DNA, 510 bp, Homo sapiens
  misc_feature: HIJSMM301EPJ6U.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtacacttttggccaggggacccaggtggagatcagactgatattaacagcgaaaagagattttgttaagggaaagtaatgaagttaa

SEQ ID NO: 603981 - DNA, 506 bp, Homo sapiens; identical to SEQ ID NO: 542696
  misc_feature: HIJSMM301B8SHM.7.71.G05.1.454.light.4.raw

SEQ ID NO: 603982 - DNA, 487 bp, Homo sapiens; identical to SEQ ID NO: 536206
  misc_feature: HIJSMM301BKB92.47.38.D05.1.454.light.4.raw

SEQ ID NO: 603983 - DNA, 514 bp, Homo sapiens
  misc_feature: HIJSMM301C4EHU.9.74.G08.1.454.light.4.raw
tgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtggccccaggaaagacggccaggataacctgtgagggaaataacattggaagtaaagtgtgcactggtatcagcagaggccaggccaggcccctgtactggtcctctatgatgacagtggccggccctcagggatccctgagcgattctctggctccaagtctggcagcacggccaccctgacccatcagcagggtcgaagccgggatgaggccgactattactgtcaggtgtggagtttaatagtgatcatccgggggtattcggcggaggaccaaggtgaccgtcctacgtcagcccaaggctcgccccctcggtccactctcgttcccaccctcctc

SEQ ID NO: 603984 - DNA, 509 bp, Homo sapiens
  misc_feature: HIJSMM301CAAIQ.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccacgttcggcccgtgggaccaaagtggatatcaaacgaactgtggctgcaccatctgtcttcta

SEQ ID NO: 603985 - DNA, 514 bp, Homo sapiens
  misc_feature: HIJSMM301AH4G1.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctacttactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctggtccactctgttcccgccctcctcgagtagtaca

SEQ ID NO: 603986 - DNA, 484 bp, Homo sapiens; identical to SEQ ID NO: 535400
  misc_feature: HIJSMM301BNI8H.46.26.C04.1.454.light.4.raw

SEQ ID NO: 603987 - DNA, 492 bp, Homo sapiens
  misc_feature: HIJSMM301D6WNL.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcgcgggggaccaaggtggagttcaaacgaactgtggctgcaccatctgtcttcat

SEQ ID NO: 603988 - DNA, 498 bp, Homo sapiens
  misc_feature: HIJSMM301DET3O.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccaaggtgaccggtcctacgtcagcccaaggctgccccctcggtcactctcg

SEQ ID NO: 603989 - DNA, 496 bp, Homo sapiens; identical to SEQ ID NO: 553382
  misc_feature: HIJSMM301EVIH0.51.59.F04.1.454.light.4.raw

SEQ ID NO: 603990 - DNA, 521 bp, Homo sapiens; identical to SEQ ID NO: 538715
  misc_feature: HIJSMM301AUA2Q.27.23.C01.1.454.light.4.raw

SEQ ID NO: 603991 - DNA, 484 bp, Homo sapiens; identical to SEQ ID NO: 535400
  misc_feature: HIJSMM301AIN2Q.46.26.C04.1.454.light.4.raw

SEQ ID NO: 603992 - DNA, 484 bp, Homo sapiens
  misc_feature: HIJSMM301EWAY4.40.69.G03.1.454.light.4.raw
tctagcgactcacgaccggtgctcgatttagtcgctgcgtaaaggagaaagggggaggaactgctcagttaggacccagacggaaccatggaagccccagcgcagcttctcttcctcctgctactctggctcccagatagcgctggagaaatagtgatgacgcagtctccagccaccctgtctgtgtctccagggaaaagagccaccctctcctgcagggccagtgagagtgttgacacctacttagcctggtaccaacacagacctggccaggctcccaggctcctcatctctggtgcatccacccgggccactggtatcccagtcaggttcagtggcagtgggtctgggacagagttcactctcaccatcagcagcctgcagtctgaagatgttgcagttattcctgtcagcagtacaatgactggccgtacacttttggccaggggaccaagctggagatcaaacgaactgtggctgcacc

SEQ ID NO: 603993 - DNA, 520 bp, Homo sapiens
  misc_feature: HIJSMM301CRNRA.43.23.C01.1.454.light.4.raw
tgtgagtagtcacgaccggtgctcgatttagtacacgtgattagggattggggctggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcggggcgaaagctgccctgacactgtcaggtgtgcagcctgaggacgaggctgactattactgcctgctcatatatggtggcgcggtgggtggttcggcggagggaccaagactgaccgtcctgggtcagcccaaggctgccccctccggtcgactcctgttcccacccct

SEQ ID NO: 603994 - DNA, 471 bp, Homo sapiens
  misc_feature: HIJSMM301AWZ9Z.52.53.E09.1.454.light.4.raw
cgcagtacgacacgaccggtgctcgatttagagagagtgtgttgggtttggggagggtgggtaagaaatacctgcaactgtcagcctcagcagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacggtatccctgatcgcttctcaggctccggctctgggactgagcgctacctcaccatctccagcctccagtctgaggacgagggtgactattactgtcagacgtgggacactggcattt

SEQ ID NO: 603995 - DNA, 509 bp, Homo sapiens
  misc_feature: HIJSMM301EDBEF.19.78.H01.1.454.light.4.raw
tactctcgtgcacgaccggtgctcgatttagtgtgagtagtttgggtttgggggggtcgacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagccccaaggcccaaccccactgtcta

SEQ ID NO: 603996 - DNA, 515 bp, Homo sapiens
  misc_feature: HIJSMM301BAXGQ.15.86.H09.1.454.light.4.raw
  modified_base (399)..(399): a, c, t, g, unknown or other
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccanacaattgatggccaagacggttgggtgttcggcggagggaccaaggctgaccgtcctaggtcagcccaaggctgccccctcggtcactctgttcccaccctcctcgctacgtagac

SEQ ID NO: 603997 - DNA, 476 bp, Homo sapiens; identical to SEQ ID NO: 537368
  misc_feature: HIJSMM301BJFE7.7.83.H06.1.454.light.4.raw

SEQ ID NO: 603998 - DNA, 496 bp, Homo sapiens
  misc_feature: HIJSMM301CFHW2.18.11.A11.1.454.light.4.raw
  modified_base (388)..(388): a, c, t, g, unknown or other
  modified_base (393)..(393): a, c, t, g, unknown or other
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttnttacngtcagcaatactatagtcctcctctcacggttcggcggagggaccaaggtggagatcaaacgactgtggctgcaccatctgtcttcatccttccgccatctga

SEQ ID NO: 603999 - DNA, 492 bp, Homo sapiens
  misc_feature: HIJSMM301D9FTM.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattgggttctaatcgggcctccggggtccctaacaggttcagtggcagtggatcaggcacagattttacactgaaaatcagcagagtggaggctgaggatgttggggtttattactgcatgcaagctctacaacctctgcggactttcggccctggaccaaagtggagatcaaacgaactatggctgcaccatctgtctt

SEQ ID NO: 604000 - DNA, 493 bp, Homo sapiens
  misc_feature: HIJSMM301CHU9G.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggaacgttcggccagggaccgaacggtcggatgtcaagacgaactgtggcgtgcaccactcttcg

SEQ ID NO: 604001 - DNA, 490 bp, Homo sapiens
  misc_feature: HIJSMM301DV97N.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagccctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtgggggctgaggatgttggcatttattactgcatgcaggctatacaccttcctgccacttttggccaggggaccaagctggagatcaggcgtaacg

SEQ ID NO: 604002 - DNA, 504 bp, Homo sapiens; identical to SEQ ID NO: 537401
  misc_feature: HIJSMM301DCFYB.51.23.C01.1.454.light.4.raw

SEQ ID NO: 604003 - DNA, 494 bp, Homo sapiens; identical to SEQ ID NO: 534994
  misc_feature: HIJSMM301BAEUB.27.78.H01.1.454.light.4.raw

SEQ ID NO: 604004 - DNA, 354 bp, Homo sapiens
  misc_feature: HIJSMM301AWQAZ.40.9.A09.1.454.light.4.raw
tctagcgactcacgaccggtgctcgatttagcgagacgcgcaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtcttttatacaactccaacaagcagcactacttagcttggtaccagcagagaccaggacaacctcctaagttgctcttttactgggcgtcttcccgggagtccggggtccctgaccgattcagtgccagcgggtctgggacagacttcactctcacca

SEQ ID NO: 604005 - DNA, 516 bp, Homo sapiens; identical to SEQ ID NO: 559247
  misc_feature: HIJSMM301EM7A7.53.6.A06.1.454.light.4.raw

SEQ ID NO: 604006 - DNA, 512 bp, Homo sapiens; identical to SEQ ID NO: 556539
  misc_feature: HIJSMM301AKTPX.5.58.F03.1.454.light.4.raw

SEQ ID NO: 604007 - DNA, 491 bp, Homo sapiens; identical to SEQ ID NO: 563114
  misc_feature: HIJSMM301CIWWN.40.57.F02.1.454.light.4.raw

SEQ ID NO: 604008 - DNA, 487 bp, Homo sapiens; identical to SEQ ID NO: 541729
  misc_feature: HIJSMM301CZC7J.40.83.H06.1.454.light.4.raw

SEQ ID NO: 604009 - DNA, 486 bp, Homo sapiens
  misc_feature: HIJSMM301D3DQF.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaacgtcccgctcactttcggcggagggaccaaggtggagatacaaacgaa

SEQ ID NO: 604010 - DNA, 484 bp, Homo sapiens; identical to SEQ ID NO: 535400
  misc_feature: HIJSMM301A630B.46.26.C04.1.454.light.4.raw

SEQ ID NO: 604011 - DNA, 453 bp, Homo sapiens; identical to SEQ ID NO: 536065
  misc_feature: HIJSMM301CQ5JY.18.78.H01.1.454.light.4.raw

SEQ ID NO: 604012 - DNA, 487 bp, Homo sapiens; identical to SEQ ID NO: 601902
  misc_feature: HIJSMM301DAWFE.7.75.G09.1.454.light.4.raw

SEQ ID NO: 604013 - DNA, 516 bp, Homo sapiens
  misc_feature: HIJSMM301B202F.48.81.H04.1.454.light.4.raw
agtatacatacacgaccggtgctcgatttagtagtgtagattcgcgggagctctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtaaccatctcctgctctggaagtagttccaacattgggaataattatgtctcctggtatcagcaactcccaggaacagcccccaaactcctcatttatgacaataataaagcgaccctcaggaattcctgaccgattctctggctccaagtctggcacgtcagccaccctgggcatcaccggactccagactgggacgaggccgattattactgcggaacatgggataaacagcccgagtggtggtcgggtcttcggcggagggaccaaagctgaccgtcctacgtcaagcccaaggctgccccccg

SEQ ID NO: 604014 - DNA, 484 bp, Homo sapiens
  misc_feature: HIJSMM301AW0LK.48.22.B11.1.454.light.4.raw
agtatacatacacgaccggtgctcgatttagacgacagctcagggggagtcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttatttagcctggtttcagcagaaaccagggaaagcccctaaactcctgatctacgctgcatccactttgcacagtggggtcccgtctaggttcagcggcagcggatctgggacagatttcactctcaccatcagcagcctgcagcctgaagatgttgcaacttattactgtcaacagcttagtagtaaccctccgtacacttttggccgagggaccaaggtggagatcaaacgaactgtggctgcaccatctgt

SEQ ID NO: 604015 - DNA, 513 bp, Homo sapiens
  misc_feature: HIJSMM301B2IRE.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaactaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctggtcactctgttcccgccctcct

SEQ ID NO: 604016 - DNA, 503 bp, Homo sapiens; identical to SEQ ID NO: 594743
  misc_feature: HIJSMM301DA6ZW.48.36.D03.1.454.light.4.raw

SEQ ID NO: 604017 - DNA, 467 bp, Homo sapiens
  misc_feature: HIJSMM301D3DZI.13.4.A04.1.454.light.4.raw
  modified_base (457)..(457): a, c, t, g, unknown or other
tcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacaggattttactttcaccatcagcagcctgcagcctgaagatattgcaacatattactgtcagcagtatgataatctcccgatcaccttcggccaagggacacgactgganattaaacgaa

SEQ ID NO: 604018 - DNA, 488 bp, Homo sapiens; identical to SEQ ID NO: 539021
  misc_feature: HIJSMM301DGAKJ.21.4.A04.1.454.light.4.raw

SEQ ID NO: 604019 - DNA, 494 bp, Homo sapiens
  misc_feature: HIJSMM301DZGNM.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacacgtgcccccccgatccaccttcggccaagggacacgactggagattaaacgaactagtggctgcaccatctgtcttcatt

SEQ ID NO: 604020 - DNA, 477 bp, Homo sapiens
  misc_feature: HIJSMM301BZ85S.48.2.A02.1.454.light.4.raw
agtatacatacacgaccggtgctcgatttagactcatctacagggggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggccagggaccaaagtggatagtcaaccgaactcgtggctgcacca

SEQ ID NO: 604021 - DNA, 499 bp, Homo sapiens
  misc_feature: HIJSMM301EL0AT.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagttttattactgtcagcaatactatagtcctcctctcacgttcggcggagggaccaaggtggagatcaaacgaactgtggctgcaccatctgtcttcatcttcccgcatctgacta

SEQ ID NO: 604022 - DNA, 504 bp, Homo sapiens; identical to SEQ ID NO: 566301
  misc_feature: HIJSMM301BHQD2.9.53.E09.1.454.light.4.raw

SEQ ID NO: 604023 - DNA, 490 bp, Homo sapiens
  misc_feature: HIJSMM301DRDPY.18.26.C04.1.454.light.4.raw
tacgagtatgcacgaccggtgctcgatttagtctagcgactttgggtttgggggggtcagacccagtcgggacacagcatggacatgagggtccccgctcagctcctggggctcctgctgctctggttcccaggttccagatgcgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgacgtgccacttttggcggggggaccgaaggtggacatcaaacgaactgtggctgcacc

SEQ ID NO: 604024 - DNA, 521 bp, Homo sapiens
  misc_feature: HIJSMM301D8UAR.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctcgccccctcggtcactctgttcccacct

SEQ ID NO: 604025 - DNA, 511 bp, Homo sapiens
  misc_feature: HIJSMM301CXCKO.48.11.A11.1.454.light.4.raw
agtatacatacacgaccggtgctcgatttagctacgactgcaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactatactgtcaggtgtgggataatggtggtgatcatccggtcttcggcggagggaccaagttgaccgtcctaagtcagcccaaggctcgccccctcggtccactctgttcccaccctcct

SEQ ID NO: 604026 - DNA, 495 bp, Homo sapiens
  misc_feature: HIJSMM301BTNLM.22.14.B03.1.454.light.4.raw
  modified_base (430)..(430): a, c, t, g, unknown or other
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatnttatattcctcctcagacgttcggccaagggaccaaggtgaaatcaaacgactgtggctgcaacc

SEQ ID NO: 604027 - DNA, 482 bp, Homo sapiens; identical to SEQ ID NO: 537205
  misc_feature: HIJSMM301BC5BJ.5.39.D06.1.454.light.4.raw

SEQ ID NO: 604028 - DNA, 513 bp, Homo sapiens
  misc_feature: HIJSMM301BW7JE.12.82.H05.1.454.light.4.raw
atacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaagagccaccctctcctgcagggccagtgagaatgttaacaacaggtatctggcctggtaccagcagaaacctggccaggctcccaggctcctcatgtacgttacttccagcagggccactggcatcccagacaggttcactggcaggtgggtctgggacagacttcactctcaccatccaccagactggagcctgaagtattttgcagtgttattattgtcagcagtatggtagcgcaccgtactacttttggccgtaggggtccaaggctggagagtagaaacgaactgtggcctgcaccatctgtcttcatccttccccg

SEQ ID NO: 604029 - DNA, 444 bp, Homo sapiens; identical to SEQ ID NO: 535192
  misc_feature: HIJSMM301BHEQE.5.9.A09.1.454.light.4.raw

SEQ ID NO: 604030 - DNA, 505 bp, Homo sapiens; identical to SEQ ID NO: 535503
  misc_feature: HIJSMM301AW3H8.8.28.C06.1.454.light.4.raw

SEQ ID NO: 604031 - DNA, 504 bp, Homo sapiens; identical to SEQ ID NO: 535709
  misc_feature: HIJSMM301EY20Y.9.55.E11.1.454.light.4.raw

SEQ ID NO: 604032 - DNA, 482 bp, Homo sapiens
  misc_feature: HIJSMM301CRF3W.4.1.A01.1.454.light.4.raw
agcactgtagcacgaccggtgctcgatttagacgtctcatcagggggaggaactgctcagttaggacccagacggaaccatggaagccccagcgcagcttctcttcctcctgctactctggcttccagaatccgctggagaaatcgtagtgacgcagtctccagccaccctgtctgtgtctccaggggagagagccaccctctcctgcagggccaatcagagtattggtcacagcttagcctggtaccagcagaaacctggccaggctcccggtctcctcatctctgctgcgtccatcagggccactggtatccctgccaggttccgtggcagtgggtctgggacagagttcactctcaccatcagcagcctgcagtctgatgatgttgcagtttattactgtcatcaatatggtgaccggcccacgttcggccaagggccaaggtggaaatcaaacgaactgtggctgcaccatctgtctt

SEQ ID NO: 604033 - DNA, 506 bp, Homo sapiens
  misc_feature: HIJSMM301EGVBF.47.65.F10.1.454.light.4.raw
agctcacgtacacgaccggtgctcgatttagctacgctctaaggggagctgtgggtagagaagacaggactcaggacaatctccagcatggccagcttccctctcctcctcaccctcctcactcactgtgcagggtcctgggcccagtctgcgttgactcagccaccctcagtgtctgggacccccgggcagacggtcgccgtctcttgttctggaagcggctccaacatcggccgtaattctgtaaactggtaccagcagctcccaggaatggcccccacactcctcatctatagggatgatcagtggccctcaggggtccctgaccgattctctggctccaagtctggcacttcagcctccctggccatcagtgggctccagtctggggatgaggctgattattactgtgcaacatgggatgacagtctgaacgcaatggtgttcggcggagggaccaaggtggccgtcctaggtcagcccaaggctgccccctcggtcacttc

SEQ ID NO: 604034 - DNA, 460 bp, Homo sapiens; identical to SEQ ID NO: 539553
  misc_feature: HIJSMM301AFI9F.11.86.H09.1.454.light.4.raw

SEQ ID NO: 604035 - DNA, 504 bp, Homo sapiens; identical to SEQ ID NO: 555616
  misc_feature: HIJSMM301C58WF.5.86.H09.1.454.light.4.raw

SEQ ID NO: 604036 - DNA, 487 bp, Homo sapiens
  misc_feature: HIJSMM301AJCNM.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctcgggacccccgggcagagggtcgtcatctcttgctctggaagcagctccaacatcggaaggaatgatgtgtactggttgcagcaactccccggaacggccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccaaactgaccgtcctaggtcagcccaaggctcgccccctcggtcactctcgttcccaccctcctctacgtgagct

SEQ ID NO: 604037 - DNA, 482 bp, Homo sapiens
  misc_feature: HIJSMM301CVYEL.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggaggggaccaaggctgaccgtcctaagtcagaccccg

SEQ ID NO: 604038 - DNA, 488 bp, Homo sapiens; identical to SEQ ID NO: 582880
  misc_feature: HIJSMM301A5TQC.43.33.C11.1.454.light.4.raw

SEQ ID NO: 604039 - DNA, 517 bp, Homo sapiens
  misc_feature: HIJSMM301A7J52.3.87.H10.1.454.light.4.raw
agacgcactccacgaccggtgctcgatttagcagtactgcgttgggtttggggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttgtctcctggtcctggtaccaaaacacccaggcaaagcccccagattaatgatttatgatgtcagtgatcggccctcaggggtttctcatcgcttttctggctccaagtctggcaacacggcctccctgaccatctctgggctccaggctgaggacgaggctgattatttctgcagctcatacacaaccggcaccactgtcgtggttttcggtggagggaccaagctgaccgtcctaggtcagcccaaggctgccccctcggtcactc

SEQ ID NO: 604040 - DNA, 478 bp, Homo sapiens; identical to SEQ ID NO: 555324
  misc_feature: HIJSMM301C9S9N.13.59.F04.1.454.light.4.raw

SEQ ID NO: 604041 - DNA, 493 bp, Homo sapiens
  misc_feature: HIJSMM301CMZR7.14.11.A11.1.454.light.4.raw
cgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccgggcaagtcagttcattagaaatgagttaggctggtatcagcagaaaccagggaaagcccctaagctcctgatctatgctgcgtccaatttacaaactggggtcccatcaaggttcagcggcagtggatctggcacagatttcactctcaccatcagcagcctgcagcctagaagtatttgactaacttattactgtctacaagattacaacttaccctacgaacgttcgccgaagggaccaaggtaggaagtacaaacgaactgtggctgcaccatcttcg

SEQ ID NO: 604042 - DNA, 499 bp, Homo sapiens; identical to SEQ ID NO: 575204
  misc_feature: HIJSMM301CNKRD.5.24.C02.1.454.light.4.raw

SEQ ID NO: 604043 - DNA, 494 bp, Homo sapiens
  misc_feature: HIJSMM301DBJHQ.40.43.D10.1.454.light.4.raw
tctagcgactcacgaccggtgctcgatttagactagcagtaaggggactgctcagttaggacccagagggaaccatggaagccccagctcagcttctcttcctcctgctactctggctcccagaaaacaccggagaaattctgttgacacagtctccaggcaccctgtctttgtctccaggggaaagagccaccctctcctgcagggccagtcagagtgtcggcaccttcttagcctggtaccaacagaagcctggccaggctcccaggctcctcatttatgaagcgtcgaacagggccactggcatcccagccaggttcagtgccagtgggtctgggacagacttcactctcaccatcagcagcctagagcctgaagattttgcactttattactgtcaccagcgtagcagctggcctcgaacgttcggccaaggaccaaggtggacatcaagcgaactgtggctgcaccatctgtcttcatcttccgcccat

SEQ ID NO: 604044 - DNA, 493 bp, Homo sapiens
  misc_feature: HIJSMM301ELFEE.51.27.C05.1.454.light.4.raw
cgatcgtatacacgaccggtgctcgatttagacgcgatcgaagggtttggggtgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacagcgacactgccgtgttcggcggggggaccaagctgaccgtcctcggtcagcccaaggctgccccctcggtcact

SEQ ID NO: 604045 - DNA, 380 bp, Homo sapiens; identical to SEQ ID NO: 540540
  misc_feature: HIJSMM301DR95R.12.78.H01.1.454.light.4.raw

SEQ ID NO: 604046 - DNA, 495 bp, Homo sapiens
  misc_feature: HIJSMM301AOGCM.41.38.D05.1.454.light.4.raw
tctatactatcacgaccggtgctcgatttagtatctgatagttgggtttggggggagccagacccagtcaggacacagcatggacatgagggtccccgctcagctcctggggctcctgctgctctggttcccaggttccagatgcgacatccagatgacccagtctccatcttctgtgtctgcatctgtcggagacagagtcaccatcacttgtcgggcgagtcagggtattggcagctacttagtctggtatcaacaaaaaccagggaaagcccctaaactccttatttatggatcatccagtttacaaagtggggtcccatcaaggttcagcggcagtggatctgggacacatttcactctcactatcagcagcctgcagcctgaggattttgcgacttactattgtcaacaggctgacagtttccctctcactttcggcggagggaccaaggtggagatcaaacgaactgtggctgcaccatctgtcttcta

SEQ ID NO: 604047 - DNA, 494 bp, Homo sapiens; identical to SEQ ID NO: 534992
  misc_feature: HIJSMM301DADZX.9.1.A01.1.454.light.4.raw

SEQ ID NO: 604048 - DNA, 474 bp, Homo sapiens
  misc_feature: HIJSMM301BDZYZ.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtctaagtcagacccg

SEQ ID NO: 604049 - DNA, 469 bp, Homo sapiens
  misc_feature: HIJSMM301CHWFK.51.1.A01.1.454.light.4.raw
cgatcgtatacacgaccggtgctcgatttagacgtctcatcagggggcaggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggaaagcccctaagctcctgatcctcgatgcatccaatttggaaacaggggtcccatcaaggttcagtgcaagtggctctgggacagatttcactttcaccatcagcagactgcagcctgaagatattgcaacatattactgtcaacagtatgataatctccgctcactttcggcggagggaccaaggtggggatcaaacgaactgt

SEQ ID NO: 604050 - DNA, 488 bp, Homo sapiens; identical to SEQ ID NO: 537260
  misc_feature: HIJSMM301EVSGW.47.70.G04.1.454.light.4.raw

SEQ ID NO: 604051 - DNA, 491 bp, Homo sapiens; identical to SEQ ID NO: 565328
  misc_feature: HIJSMM301BASHI.10.20.B09.1.454.light.4.raw

SEQ ID NO: 604052 - DNA, 463 bp, Homo sapiens; identical to SEQ ID NO: 535062
  misc_feature: HIJSMM301DTC8E.11.73.G07.1.454.light.4.raw

SEQ ID NO: 604053 - DNA, 512 bp, Homo sapiens
  misc_feature: HIJSMM301CWVWA.48.36.D03.1.454.light.4.raw
agtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgatttattacttgctgttctattttctaagtttccttttttgttctttcggaactgggaccgaggtcaccgtcctaggtcagcccaaggccaaccccactgtcta

SEQ ID NO: 604054 - DNA, 488 bp, Homo sapiens
  misc_feature: HIJSMM301BIT8H.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccaagggaccaaggtaggaactcaaacgaa

SEQ ID NO: 604055 - DNA, 498 bp, Homo sapiens
  misc_feature: HIJSMM301A1W84.19.78.H01.1.454.light.4.raw
tactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaacccactgtcactctgttcccaccctcctccacgagagta

SEQ ID NO: 604056 - DNA, 503 bp, Homo sapiens; identical to SEQ ID NO: 594165
  misc_feature: HIJSMM301CKZ6T.18.78.H01.1.454.light.4.raw

SEQ ID NO: 604057 - DNA, 507 bp, Homo sapiens
  misc_feature: HIJSMM301C0BFV.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggagtcgtccagggaccgacgagtacgaaatagagacgaactagtggctgcaccactctgtcttctactcttcccgt

SEQ ID NO: 604058 - DNA, 481 bp, Homo sapiens; identical to SEQ ID NO: 535993
  misc_feature: HIJSMM301EAGQE.21.25.C03.1.454.light.4.raw

SEQ ID NO: 604059 - DNA, 524 bp, Homo sapiens
  misc_feature: HIJSMM301ELH71.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggccaacgggaccgaacggtaggaaggtacaaacgaactagtggcgtgcaccactctcgtcttctatcttcccgtccactctcgat

SEQ ID NO: 604060 - DNA, 493 bp, Homo sapiens
  misc_feature: HIJSMM301CLJX9.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaagtttcggtggtagggaccaaggtggaggtcaaacgaactgtggctgcaccatctgtctctatt

SEQ ID NO: 604061 - DNA, 484 bp, Homo sapiens; identical to SEQ ID NO: 554040
  misc_feature: HIJSMM301AX7LJ.4.71.G05.1.454.light.4.raw

SEQ ID NO: 604062 - DNA, 491 bp, Homo sapiens; identical to SEQ ID NO: 535294
  misc_feature: HIJSMM301BE763.16.68.G02.1.454.light.4.raw

SEQ ID NO: 604063 - DNA, 491 bp, Homo sapiens; identical to SEQ ID NO: 549611
  misc_feature: HIJSMM301EMBNM.5.57.F02.1.454.light.4.raw

SEQ ID NO: 604064 - DNA, 504 bp, Homo sapiens
  misc_feature: HIJSMM301CU6Y9.47.83.H06.1.454.light.4.raw
agctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctgggtccctgatcgcttctctggttccatccttgggaacaagctgccctcaccatcgcgggggcccaggcagatgatgagtgtgattattactgtgtgctctatatggcagtggcgtttgggtgttcggcggagggaccaagctgaccgttcg

SEQ ID NO: 604065 - DNA, 493 bp, Homo sapiens
  misc_feature: HIJSMM301DX99T.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgctaacttatttttgtctaacaggctaacactttccccctcactttcggcggagggaccaaggtggagatcaagcgaactgtggctgcaccatctgtctt

SEQ ID NO: 604066 - DNA, 488 bp, Homo sapiens
  misc_feature: HIJSMM301CDEC8.14.33.C11.1.454.light.4.raw
cgtctagtaccacgaccggtgctcgatttagagtgagctcgttgggtttgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctgccccctcggtcactctgttcccaccctcctcgtactagacg

SEQ ID NO: 604067 - DNA, 507 bp, Homo sapiens
  misc_feature: HIJSMM301BOJDP.8.34.D01.1.454.light.4.raw
ctcgcgtgtccacgaccggtgctcgatttagatcgtctgtgttgggtttggggaggaactgctcagttaggacccagagggaaccatgggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccggggccactttcggccctgggaccaaagtggatatcaaacgaactgtggctgcaccatctgtcttcta

SEQ ID NO: 604068 - DNA, 491 bp, Homo sapiens
  misc_feature: HIJSMM301BW1I4.17.53.E09.1.454.light.4.raw
cgtagactagcacgaccggtgctcgatttagagagagtgtgttgggtttgggggagctgctcagttaggacccagagggaaccatggaaaccccagcgcagcttctcttcctcctgctactctggctcccagatgtcaccggagaagttgtgttgacgcagtctccagccaccctgtctttgtctccaggggaaaagccaccctctcctgctgggccagccagtatgtcagcagtgataatttagcctggtatcagcaaaaacatggccaggctcccaggctcctcatctttggtgcatccagcaggatcactggcgtccctgacaggttcagaggcagggggtctgggacagacttcactctcaccatcaacagactggagcctgaagattttgcaatttatattgtcagcagtatggttcctcaccatctttcggcggagggaccagggtggagatgaatcgaactgtggctgcaccatctgtcttcta

SEQ ID NO: 604069 - DNA, 496 bp, Homo sapiens; identical to SEQ ID NO: 556037
  misc_feature: HIJSMM301CPKFT.41.38.D05.1.454.light.4.raw

SEQ ID NO: 604070 - DNA, 498 bp, Homo sapiens
  misc_feature: HIJSMM301B9H00.12.38.D05.1.454.light.4.raw
atacgacgtacacgaccggtgctcgatttagtatctgatagttgggtttgggggaactgctcagttaggacccagacggaaccatggaagccccagcgcagcttctcttcctcctgctactctggctcccagattcctctggagaagttgtgatgacgcagtctccagccaccctgtctgcgtctccaggggaaagagtcaccctctcatgcagggccagtgagattgttaccaccaacttagcctggtaccaacagaaacctggccagcctcccaggctcctcatttatggtgcatccacaagggccgctggtgtcccagccaggttcagtggcagtggatctgcgacagagttcactctcaccgtcagcagcctgcagtctgagattttgcagtttattactgtcagcagtatgagaagtggttcaagactttcggtcggagggaccgaaggtggaggagtcaaacgaactgtggcgtgcaccatctgtcttcatt

SEQ ID NO: 604071 - DNA, 384 bp, Homo sapiens; identical to SEQ ID NO: 560149
  misc_feature: HIJSMM301C8Q3K.48.34.D01.1.454.light.4.raw

SEQ ID NO: 604072 - DNA, 489 bp, Homo sapiens; identical to SEQ ID NO: 535139
  misc_feature: HIJSMM301CZ1JP.14.55.E11.1.454.light.4.raw

SEQ ID NO: 604073 - DNA, 493 bp, Homo sapiens; identical to SEQ ID NO: 537239
  misc_feature: HIJSMM301BW2QV.49.66.F11.1.454.light.4.raw

SEQ ID NO: 604074 - DNA, 490 bp, Homo sapiens
  misc_feature: HIJSMM301D1XO3.16.72.G06.1.454.light.4.raw
tgtactactccacgaccggtgctcgatttagctacgactgcaagggaaagggggaggaactgctcagttaggacccagacggaaccatggaagccccagcgcagcttctcttcctcctgctactctggctcccagatacctctggagaaacagtgatgacgcagtctccagccaccctctctgtgtctccaggggaaagagtcaccctctcctgcagggccagtcagagtgttagcagcaacttagcctggtatcagcagaaacctggccaggctcccaggctcctcatctatgatgcatccaccagggccactggtatcccagccaggttcagtggcagtgggtttgggacagagttcactctcaccatcagcagcctgcagtctgaagattttgcagtttattactgtcagcagtataataactggcctccggtcactttcggcggagggaccaaggtggagatacaaacgaactgtggctgcaccat

SEQ ID NO: 604075 - DNA, 505 bp, Homo sapiens
  misc_feature: HIJSMM301A6VWE.2.35.D02.1.454.light.4.raw
acgctcgacacacgaccggtgctcgatttagcacacgatagttgggtttgggggtctcaggaggcagcgctctcagggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtcctgggtcagcccaaggctgccccctcggtcta

SEQ ID NO: 604076 - DNA, 502 bp, Homo sapiens
  misc_feature: HIJSMM301EPSBC.41.18.B07.1.454.light.4.raw
tctatactatcacgaccggtgctcgatttagtcgctgcgtaaggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcggggggaccaaggctgaccgtcctaggtcagcccaaggctgccccctcggtcactcttccg

SEQ ID NO: 604077 - DNA, 505 bp, Homo sapiens
  misc_feature: HIJSMM301DWP07.48.16.B05.1.454.light.4.raw
agtatacatacacgaccggtgctcgatttagagctcacgtaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctagacaatcgattaccatctcctgcactggaaccagcagtgatattgggagtcataaccttgtctcctggtatcaacaatatccaggcagagcccccaactcataatttatgcggcctctcagcggcccccaggggtttccagtcgcttctctgcctccaagtctggcaacacggcctccttgacaatctctggcctccagcctgaggacgaggctgactattactgctgctcatatacaactatgaatgcttttttgttcggtcggagggaccaaactgaccgtcctcggtcggcccaaggctgccccctcggtcactctcg

SEQ ID NO: 604078 - DNA, 493 bp, Homo sapiens
  misc_feature: HIJSMM301EW2GS.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctgctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggcagtttattactgtcagcagtattatactactcctctgacgttcggccaagggaccaaggtggagatcaaacgaactgtggctgcaccat

SEQ ID NO: 604079 - DNA, 472 bp, Homo sapiens
  misc_feature: HIJSMM301A94PO.8.67.G01.1.454.light.4.raw
ctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaattggtatcaacagagcccaggaaaagcccccaaactcctgatttatggtgcatccatttcgcaaagtggggtcccatcaaggttcagtggcagtggatctggggcagatttcaccctcaccatcagcagtctgcaacctgaagactttgcaacttactactgtcagcagtcttacagtaggccgggcacctttggccaggggacgaagctggagatcgaacgaactgtggctgcaccatctgtcttcatcttccgccatctgagacacgcgag

SEQ ID NO: 604080 - DNA, 487 bp, Homo sapiens; identical to SEQ ID NO: 536536
  misc_feature: HIJSMM301CC2CI.26.45.E01.1.454.light.4.raw

SEQ ID NO: 604081 - DNA, 488 bp, Homo sapiens
  misc_feature: HIJSMM301DVM9C.41.57.F02.1.454.light.4.raw
tctatactatcacgaccggtgctcgatttagctcgatatagttgggtttggggtccaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacagctacaatgttggcaacgaaggagcagcttggctgcagcagtaccagggccaccctcccaaattgctatcatacaggaagaacaaccgcccctcggggatctccgagagattctctgcatcaaacgtcaggaaacatagcctccctgaccattactggactccagcctgaggacgaggctgactattactgctcagcatgggacagcagcctcaatgtttgggtgttcggcggagggaccaagctgaccgtcctaggtcacg

SEQ ID NO: 604082 - DNA, 492 bp, Homo sapiens; identical to SEQ ID NO: 548815
  misc_feature: HIJSMM301CB5K0.22.65.F10.1.454.light.4.raw

SEQ ID NO: 604083 - DNA, 499 bp, Homo sapiens
  misc_feature: HIJSMM301DPRDC.3.37.D04.1.454.light.4.raw
agacgcactccacgaccggtgctcgatttagtagcatactgttgggtttgggggatcaggactcctcagttcaccttctcacaatgaggctccctgctcagctcctggggctgctaatgctctgggtctctggatccagtggggacattgtcatgactcagtctccactctccctggccgtcacacctggagagacggcctccatctcctgcaggtctagtgagagcgtccagggtaatggatacgactatttggattggtacctgcagaagccagggcagcccccacaactcctgatctacttggcttctaatcgggcctccggggtccctgacaggttcagcggcagtggatcaggcacagattttaaactgataatcagccgcgtggaggctgaggatgttgggatttattactgcgtgcaagttcgacaaaccccattcactttcggccctgggaccaaagtggacatcaaacgaactgtggctgcaccatctgt

SEQ ID NO: 604084 - DNA, 514 bp, Homo sapiens; identical to SEQ ID NO: 557408
  misc_feature: HIJSMM301D1T6X.8.43.D10.1.454.light.4.raw

SEQ ID NO: 604085 - DNA, 484 bp, Homo sapiens; identical to SEQ ID NO: 535400
  misc_feature: HIJSMM301CUW5R.46.26.C04.1.454.light.4.raw

SEQ ID NO: 604086 - DNA, 479 bp, Homo sapiens; identical to SEQ ID NO: 535118
  misc_feature: HIJSMM301DEGZI.13.59.F04.1.454.light.4.raw

SEQ ID NO: 604087 - DNA, 496 bp, Homo sapiens
  misc_feature: HIJSMM301DEN6X.46.35.D02.1.454.light.4.raw
actagcagtacacgaccggtgctcgatttagcacacgatagttggggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccgaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagtatttgcagtctattactgtcagcagtatggtcacgtcccaagtaacttttggccgaggggaccaagctggagatacaaacgaactgtggctgcaccatcttcg

SEQ ID NO: 604088 - DNA, 496 bp, Homo sapiens; identical to SEQ ID NO: 560353
  misc_feature: HIJSMM301APLPZ.43.16.B05.1.454.light.4.raw

SEQ ID NO: 604089 - DNA, 498 bp, Homo sapiens
  misc_feature: HIJSMM301COCHO.48.36.D03.1.454.light.4.raw
agtatacatacacgaccggtgctcgatttagctgcgtcacgatctctcttggggactttgcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttcaagtttcctttttgtcttcggaactgggaccgaggtcaccgtcctaggtcagcccaaggccaaccccactgtcactctgttcccaccctcctctactgtatact

SEQ ID NO: 604090 - DNA, 492 bp, Homo sapiens
  misc_feature: HIJSMM301C64LH.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgcagtttattactgtcagcagtatgatacctggcctccgtacacttttggccgggggaccaagctggaatcaagcgaactgtggctgcaccatctgtcttcatt

SEQ ID NO: 604091 - DNA, 504 bp, Homo sapiens
  misc_feature: HIJSMM301BT6JW.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtaggaaatcaaacgaactgtaggctgcaccatctgtcttcatcttccccg

SEQ ID NO: 604092 - DNA, 511 bp, Homo sapiens
  misc_feature: HIJSMM301CGB0J.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctcggcgacgtcgcacggaccgaaggtaggaagtacagacgaacgtgtggctgcaccactctgtcttcatcttccgtccact

SEQ ID NO: 604093 - DNA, 498 bp, Homo sapiens
  misc_feature: HIJSMM301A6AS4.47.38.D05.1.454.light.4.raw
agctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgcttgaaaatcagtagggtggaggctgaggatgttggggtttattactgcatgcaagttctacaaacttcctacacttttggccaggggaccaagctggagatcaaacgaactagtggctgcaa

SEQ ID NO: 604094 - DNA, 502 bp, Homo sapiens
  misc_feature: HIJSMM301EATVY.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccgccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaagtggatatcaaacgaactgtggctgcaccatctgt

SEQ ID NO: 604095 - DNA, 486 bp, Homo sapiens; identical to SEQ ID NO: 535385
  misc_feature: HIJSMM301ESTH8.19.71.G05.1.454.light.4.raw

SEQ ID NO: 604096 - DNA, 492 bp, Homo sapiens
  misc_feature: HIJSMM301CPM7O.52.73.G07.1.454.light.4.raw
cgcagtacgacacgaccggtgctcgatttagctctacgctcagggcacgaccggtgctcgatttagtatctgatagttgggtttggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtatggtacttatgtgcagttcggcggagggaaccg

SEQ ID NO: 604097 - DNA, 487 bp, Homo sapiens; identical to SEQ ID NO: 537573
  misc_feature: HIJSMM301BF2YI.3.10.A10.1.454.light.4.raw

SEQ ID NO: 604098 - DNA, 484 bp, Homo sapiens
  misc_feature: HIJSMM301ED8PG.17.34.D01.1.454.light.4.raw
cgtagactagcacgaccggtgctcgatttagatcgtctgtgttgggtttgggtcatcacaatatctgcactggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggcccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccaagggaccaaggtggaactcaaacgaactgtggctgcaccatctgtcttcatcttccgccatctgactagtctacg

SEQ ID NO: 604099 - DNA, 512 bp, Homo sapiens
  misc_feature: HIJSMM301A0M6E.14.19.B08.1.454.light.4.raw
  modified_base (437)..(437): a, c, t, g, unknown or other
  modified_base (498)..(498): a, c, t, g, unknown or other
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtnttcggcggagggaccaagctgaccgtctaagtcagcccaaggctgccccctggtcactctnttcccgcctcctcg

SEQ ID NO: 604100 - DNA, 504 bp, Homo sapiens; identical to SEQ ID NO: 535561
  misc_feature: HIJSMM301DPH31.4.57.F02.1.454.light.4.raw

SEQ ID NO: 604101 - DNA, 492 bp, Homo sapiens; identical to SEQ ID NO: 534967
  misc_feature: HIJSMM301EE9BL.47.64.F09.1.454.light.4.raw

SEQ ID NO: 604102 - DNA, 509 bp, Homo sapiens
  misc_feature: HIJSMM301AFHY9.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagactccactctcaccatcagcagcctggagcctgaagatattgcagtttattattgtcagcagcgtagcaggtggcctttcactttcggcccggggaccaaagtggaaatcaaacgaactgtggctgcaccatctgtcttcatcttcccgccat

SEQ ID NO: 604103 - DNA, 507 bp, Homo sapiens
  misc_feature: HIJSMM301BAKNG.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaactccactgtcacttcc

SEQ ID NO: 604104 - DNA, 506 bp, Homo sapiens
  misc_feature: HIJSMM301BPENZ.9.71.G05.1.454.light.4.raw
tgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctcgtccccccg

SEQ ID NO: 604105 - DNA, 497 bp, Homo sapiens; identical to SEQ ID NO: 560060
  misc_feature: HIJSMM301AN6MU.22.86.H09.1.454.light.4.raw

SEQ ID NO: 604106 - DNA, 494 bp, Homo sapiens; identical to SEQ ID NO: 539894
  misc_feature: HIJSMM301D6A01.16.53.E09.1.454.light.4.raw

SEQ ID NO: 604107 - DNA, 496 bp, Homo sapiens; identical to SEQ ID NO: 542319
  misc_feature: HIJSMM301C0FNP.26.72.G06.1.454.light.4.raw

SEQ ID NO: 604108 - DNA, 491 bp, Homo sapiens
  misc_feature: HIJSMM301EB0B5.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcaccttgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtctaggtcagcccaaggccaaccccactcg

SEQ ID NO: 604109 - DNA, 517 bp, Homo sapiens
  misc_feature: HIJSMM301A5T89.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggaggggaccaagctgaccgtcttaagtcagcccaaggctgccccctcggtcactctgttcccgccctcctcc

SEQ ID NO: 604110 - DNA, 489 bp, Homo sapiens; identical to SEQ ID NO: 535139
  misc_feature: HIJSMM301BM22S.14.55.E11.1.454.light.4.raw

SEQ ID NO: 604111 - DNA, 496 bp, Homo sapiens; identical to SEQ ID NO: 535109
  misc_feature: HIJSMM301BIIT3.16.78.H01.1.454.light.4.raw

SEQ ID NO: 604112 - DNA, 507 bp, Homo sapiens; identical to SEQ ID NO: 538702
  misc_feature: HIJSMM301A6TDH.11.57.F02.1.454.light.4.raw

SEQ ID NO: 604113 - DNA, 476 bp, Homo sapiens; identical to SEQ ID NO: 550689
  misc_feature: HIJSMM301C0Q79.3.1.A01.1.454.light.4.raw

SEQ ID NO: 604114 - DNA, 446 bp, Homo sapiens
  misc_feature: HIJSMM301C2W8U.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcggcggagggaccaagctgaccgtcctaggtcagcccaaggcctgccccctcggtcactctgttccccaccctcctcagacgtatca

SEQ ID NO: 604115 - DNA, 479 bp, Homo sapiens
  misc_feature: HIJSMM301D7GY4.48.2.A02.1.454.light.4.raw
agtatacatacacgaccggtgctcgatttagactcatctacaggggggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggccagggaccgaaagtggaatgtcaaccgaactagtggctgcacca

SEQ ID NO: 604116 - DNA, 486 bp, Homo sapiens; identical to SEQ ID NO: 535290
  misc_feature: HIJSMM301DWWPI.3.12.B01.1.454.light.4.raw

SEQ ID NO: 604117 - DNA, 488 bp, Homo sapiens; identical to SEQ ID NO: 572737
  misc_feature: HIJSMM301EQO4R.5.40.D07.1.454.light.4.raw

SEQ ID NO: 604118 - DNA, 493 bp, Homo sapiens; identical to SEQ ID NO: 535047
  misc_feature: HIJSMM301DWT0X.16.53.E09.1.454.light.4.raw

SEQ ID NO: 604119 - DNA, 454 bp, Homo sapiens; identical to SEQ ID NO: 534964
  misc_feature: HIJSMM301CPSYA.19.86.H09.1.454.light.4.raw

SEQ ID NO: 604120 - DNA, 480 bp, Homo sapiens; identical to SEQ ID NO: 579036
  misc_feature: HIJSMM301DQGYH.7.67.G01.1.454.light.4.raw

SEQ ID NO: 604121 - DNA, 480 bp, Homo sapiens
  misc_feature: HIJSMM301B3XHH.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggatttgcaacttattactgtctacaagattacacttaccctgggacgttcggccaagggaccaaggtggaaatcaaacgaactgtggctgcaccta

SEQ ID NO: 604122 - DNA, 518 bp, Homo sapiens; identical to SEQ ID NO: 539372
  misc_feature: HIJSMM301CGR8N.7.86.H09.1.454.light.4.raw

SEQ ID NO: 604123 - DNA, 495 bp, Homo sapiens
  misc_feature: HIJSMM301AMW4U.27.78.H01.1.454.light.4.raw
  modified_base (482)..(482): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactagtggctncaccatctgtctt

SEQ ID NO: 604124 - DNA, 490 bp, Homo sapiens
  misc_feature: HIJSMM301BT5XG.19.71.G05.1.454.light.4.raw
tactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgaactgacaagtccagccacaatcttttatacagttccaacaatgaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattacttgtcaacaatattattatacttcgtggacgttcggaccaagggaccaaggtggatatcagacgaa

SEQ ID NO: 604125 - DNA, 501 bp, Homo sapiens
  misc_feature: HIJSMM301ASKBO.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaaacccca

SEQ ID NO: 604126 - DNA, 516 bp, Homo sapiens; identical to SEQ ID NO: 546077
  misc_feature: HIJSMM301DSKDN.17.33.C11.1.454.light.4.raw
  modified_base (507)..(507): a, c, t, g, unknown or other

SEQ ID NO: 604127 - DNA, 489 bp, Homo sapiens
  misc_feature: HIJSMM301D3SG5.49.82.H05.1.454.light.4.raw
agtcgagagacacgaccggtgctcgatttagtcgagctctctcgcgggcacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgaccg

SEQ ID NO: 604128 - DNA, 502 bp, Homo sapiens; identical to SEQ ID NO: 536253
  misc_feature: HIJSMM301BUBBA.21.22.B11.1.454.light.4.raw

SEQ ID NO: 604129 - DNA, 486 bp, Homo sapiens
  misc_feature: HIJSMM301A7PDJ.40.81.H04.1.454.light.4.raw
tctagcgactcacgaccggtgctcgatttagtagtgtagattcgcggggtggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtgggcagtggatcagtcacagattttacactgaaaatcagcagggtggaggcagaagatgttgggatttattactgcatgcaacctctacaactgtgtggacggtcggccaagggaccaaggtgaaatcaagcgaactgtgg

SEQ ID NO: 604130 - DNA, 501 bp, Homo sapiens
  misc_feature: HIJSMM301A9CTC.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgacgtcctgggtcagccaaggctgcccctcggtcactctgttcccgccctcctctacgtctat

SEQ ID NO: 604131 - DNA, 504 bp, Homo sapiens; identical to SEQ ID NO: 537401
  misc_feature: HIJSMM301B4QS1.51.23.C01.1.454.light.4.raw

SEQ ID NO: 604132 - DNA, 521 bp, Homo sapiens
  misc_feature: HIJSMM301AZCF7.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcacgccagctcgccccctcggtcactctcgttcccaccct

SEQ ID NO: 604133 - DNA, 484 bp, Homo sapiens; identical to SEQ ID NO: 538770
  misc_feature: HIJSMM301ECAVI.4.57.F02.1.454.light.4.raw

SEQ ID NO: 604134 - DNA, 468 bp, Homo sapiens
  misc_feature: HIJSMM301B4PCT.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggagatcagacgaactgtggctgcaccatctgtcttctactccttcccgccatctagaagtatagtct

SEQ ID NO: 604135 - DNA, 519 bp, Homo sapiens
  misc_feature: HIJSMM301BKJ9F.40.42.D09.1.454.light.4.raw
tctagcgactcacgaccggtgctcgatttagacacatacgcagggaaagggggggcctaaggaagcagcactggtggtgcctcagccatggcctggaccgttctcctcctcggcctcctctctcactgcacagggtctgtgacctcctatgtgctgactcagccactctcggtgtctgtggccccaggacaggcggccaatgttacctgtgggggagacaacattgggagtaaaagtgtgcactggtaccagctgaagccaggccaggcccctgtgttggtcgtctttggacatggtgcccgaccctcggggatccctgagcgattctctgcctccaggtctgggaacacggccaccctgaccatcaccagggtcgaggccggagatgaggccgactattttgtcacgtgtggcacgttagtcatcacgtcttcggaactgggaccacggtcaccgtcctaagtcagcccaaggccaaccccactgtcactctgttccccaccctcctcagtcgctaga

SEQ ID NO: 604136 - DNA, 514 bp, Homo sapiens; identical to SEQ ID NO: 603221
  misc_feature: HIJSMM301DWWDR.43.59.F04.1.454.light.4.raw

SEQ ID NO: 604137 - DNA, 512 bp, Homo sapiens
  misc_feature: HIJSMM301A9N8M.3.37.D04.1.454.light.4.raw
agacgcactccacgaccggtgctcgatttagtagcatactgttgggtttggggggggtctcaggaggcagtgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccagcagtgacgttggtagatataattatgtctcctggtaccaacaactcccaggcaaagcccccaaactgatgatttatgatgtcaataatcggccctcaggggtttctaatcgcttctctggctccaagtctggcaacacggcctccctgaccatctctgggctccagggtgaggacgaggctgattatttctgcagctcatacacaaccggcaccactgtcgtggttttcggtggagggaccaagctgaccgtcctaggtcagcccaaggctgccccctcggtcactc

SEQ ID NO: 604138 - DNA, 497 bp, Homo sapiens
  misc_feature: HIJSMM301BINSR.51.26.C04.1.454.light.4.raw
cgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggctgcgattttcggcggagggaccagtctgacgtcctaggtcagcccaaggctgcccctcggtcactctcg

SEQ ID NO: 604139 - DNA, 491 bp, Homo sapiens
  misc_feature: HIJSMM301C5G91.43.20.B09.1.454.light.4.raw
  modified_base (474)..(474): a, c, t, g, unknown or other
tgtgagtagtcacgaccggtgctcgatttagtgtagtgtgaagggggaagagctgctcagttaggacccagagggaaccatggaaaccccagcgcagcttctcttcctcctgctactctggctcccagataccaccggagaaattgtgttgacgcagtctccgggcaccctgtctttgtctccaggggatagagccaccctctcctgcagggccagtcagagtgttagcagcacctacttagcctggtaccagcagaaacctggccaggctcccaggctcctcatctatgatgcatccagcagggccactggcatcccagacaggttcagtggcaggtgggtctgggacagacttcactctcaccatcagcagactggagcctgaagattttgcagtgtattactgtcaccagtatggtagctcactaagacgttcggccaagggaccaaggtagaaatcaaacgaactgtggntgcacatctgtcttcta

SEQ ID NO: 604140 - DNA, 511 bp, Homo sapiens; identical to SEQ ID NO: 537464
  misc_feature: HIJSMM301DSKMA.7.34.D01.1.454.light.4.raw

SEQ ID NO: 604141 - DNA, 512 bp, Homo sapiens
  misc_feature: HIJSMM301EKAT7.14.78.H01.1.454.light.4.raw
cgtctagtaccacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgcaactaatggtgagattgggacttataaccttgtctcctggtaccaacaacatccagacaaagcccccaaactcatcatttatgagaccactaagcggccctcaggggtttctgatcgcttctctgcctccaagtctggccacacggcctccctgacaatctctgggctccagactgaggacgagggtgattattactgctgctcatacggagggactagaactttgctattcggcggagggaccaagttgaccgtctaagtcagcccaaggctgccccctcggtcactctgtt

SEQ ID NO: 604142 - DNA, 510 bp, Homo sapiens
  misc_feature: HIJSMM301ADBQC.43.3.A03.1.454.light.4.raw
tgtgagtagtcacgaccggtgctcgatttagagagcgtcacagggggggtagctcaggaagcagagcctggagcatctccactatggcctgggctccactacttctcaccctcctcgctcactgcacaggttcttgggccagttttatgctgactcagccccactctgtgtcggagtctccggggaagacggtaaccatctcctgcacccgcagcggtggctttattgccagcaataatatgcagtggtaccagcagcgcccgggcagtccccccaccactgtgatctatgaggatgaccaaagaccctctggggtccctaatcggttctctggctccgtcgacacctcctccaactctgcctacctcaccatctctggactgaagactgaggacgaggctgactattactgtcactcttatgatcgcaacaacagggtgttcggcggagggaccaggttgaccgtccttggtcagcccaaggctgccccctcggtcactctgttcccca

SEQ ID NO: 604143 - DNA, 486 bp, Homo sapiens; identical to SEQ ID NO: 537428
  misc_feature: HIJSMM301C9OHJ.47.62.F07.1.454.light.4.raw

SEQ ID NO: 604144 - DNA, 487 bp, Homo sapiens; identical to SEQ ID NO: 536206
  misc_feature: HIJSMM301C8G4U.47.38.D05.1.454.light.4.raw

SEQ ID NO: 604145 - DNA, 483 bp, Homo sapiens; identical to SEQ ID NO: 535413
  misc_feature: HIJSMM301DFEK5.26.78.H01.1.454.light.4.raw

SEQ ID NO: 604146 - DNA, 490 bp, Homo sapiens; identical to SEQ ID NO: 535420
  misc_feature: HIJSMM301DFU16.3.72.G06.1.454.light.4.raw

SEQ ID NO: 604147 - DNA, 518 bp, Homo sapiens; identical to SEQ ID NO: 539372
  misc_feature: HIJSMM301DDIBN.7.86.H09.1.454.light.4.raw

SEQ ID NO: 604148 - DNA, 507 bp, Homo sapiens
  misc_feature: HIJSMM301C89WH.5.24.C02.1.454.light.4.raw
  modified_base (498)..(498): a, c, t, g, unknown or other
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcagccaaggcngtccccccg

SEQ ID NO: 604149 - DNA, 489 bp, Homo sapiens
  misc_feature: HIJSMM301A3YSO.19.71.G05.1.454.light.4.raw
  modified_base (318)..(318): a, c, t, g, unknown or other
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggctttanctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 604150 - DNA, 497 bp, Homo sapiens
  misc_feature: HIJSMM301DKGOI.41.20.B09.1.454.light.4.raw
tctatactatcacgaccggtgctcgatttagtgtagtgtgaagggggagtcagacccagtcaggacacagcatggacatgagggtccccgctcagctcctggggctcctgctgctctggctcccaggtgccaaatgtgagatccagatgacccagtctccttccaccctgtctgcatctgttggagacacagtcaccatcacttgccgggccagtcagtatattaatgactggttggcctggtatcagcagaaaagagggagggccccaaagctcctgatttacaaggcaggctatttagaaatggggccccatcaagatttagtggctttggaactgggacggagttcactctcaccatcaccggcctgcagcctgatgactttgcaacttattactgccagcaatatgacgtttacccgctcactttcggcggagggaccaaggtggagatcaaaggaactgtggctgcaccatctgtcttcatcttcccgccta

SEQ ID NO: 604151 - DNA, 488 bp, Homo sapiens; identical to SEQ ID NO: 535990
  misc_feature: HIJSMM301BXTCR.11.28.C06.1.454.light.4.raw

SEQ ID NO: 604152 - DNA, 493 bp, Homo sapiens
  misc_feature: HIJSMM301CDGKK.15.59.F04.1.454.light.4.raw
tctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaagctgccctcaccatcacgggggcccaggcagatgatgaatctgtttattattgtgtcctatatatgggtgctggcatttcggtcttcggcggagggaccaagctgaccgtcctaggtcagcccaaggctgccccctcggtcactctgttcccgccctcctcgctacgtaga

SEQ ID NO: 604153 - DNA, 487 bp, Homo sapiens
  misc_feature: HIJSMM301BXJ47.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccgaggggaccaagctggagatcaaacgaactgtggctgcaccat

SEQ ID NO: 604154 - DNA, 488 bp, Homo sapiens
  misc_feature: HIJSMM301C36J8.11.12.B01.1.454.light.4.raw
cgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaaataccaggcggccctctggggtccctgagcgattctccggctccggctctgggaacacagtcactctgaccatcagcgggacccaggctattgatgaggctgtctacttctgtcaggcgtgggacacagcgtggtgttcggcggagggaccagtctgaccgtcttaggtcagcccaaggctgccccctcggtcact

SEQ ID NO: 604155 - DNA, 506 bp, Homo sapiens
  misc_feature: HIJSMM301BI3GO.47.85.H08.1.454.light.4.raw
agctcacgtacacgaccggtgctcgatttagtatcactcagtcgcgggggctggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgcccctcggtcact

SEQ ID NO: 604156 - DNA, 495 bp, Homo sapiens
  misc_feature: HIJSMM301B6QOW.43.33.C11.1.454.light.4.raw
tgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgaaacagatttttctctcgtcatcactggtctacagtctgacgacggcgcaatgtacttctgtcaacactatgcctctcccccctacaatttcggtcaggggaccaagttgaacatcaatcgaactgtggctgcaccatctgtcttcta

SEQ ID NO: 604157 - DNA, 505 bp, Homo sapiens; identical to SEQ ID NO: 536254
  misc_feature: HIJSMM301BEK77.7.71.G05.1.454.light.4.raw

SEQ ID NO: 604158 - DNA, 496 bp, Homo sapiens; identical to SEQ ID NO: 537925
  misc_feature: HIJSMM301DQW5H.22.14.B03.1.454.light.4.raw

SEQ ID NO: 604159 - DNA, 481 bp, Homo sapiens; identical to SEQ ID NO: 535993
  misc_feature: HIJSMM301CQVNL.21.25.C03.1.454.light.4.raw

SEQ ID NO: 604160 - DNA, 506 bp, Homo sapiens
  misc_feature: HIJSMM301CX96S.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccttggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtaggaaatacaaacgaaactgtggctgcaccatctgtcttcatcttccccg

SEQ ID NO: 604161 - DNA, 499 bp, Homo sapiens; identical to SEQ ID NO: 540144
  misc_feature: HIJSMM301AN59D.47.66.F11.1.454.light.4.raw

SEQ ID NO: 604162 - DNA, 509 bp, Homo sapiens
  misc_feature: HIJSMM301DSQVV.21.87.H10.1.454.light.4.raw
tcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaaactccttaatttctggcgtcaatcagcgaccctcacatgtttccagtcgattctctgcatccaagtctggcaacacggcctttctgacaatctctcaactccaggctgaagacgaggctatttattactgctcctcatacgcaggtggcacatttttcttggtttttggcggtcgggacccagatgactgtcctcagtcagcccaaggctgccccctcggt

SEQ ID NO: 604163 - DNA, 479 bp, Homo sapiens; identical to SEQ ID NO: 535118
  misc_feature: HIJSMM301ELCAV.13.59.F04.1.454.light.4.raw

SEQ ID NO: 604164 - DNA, 519 bp, Homo sapiens
  misc_feature: HIJSMM301BWTKO.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccgaacgggaccaaggtaggaaggtacgtaaacgaacgtagtggcgtgcaccactctgtcttctatcttcccgtccact

SEQ ID NO: 604165 - DNA, 449 bp, Homo sapiens
  misc_feature: HIJSMM301A27I3.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggcccaacccctctgtcactctgttccccaccctcctccatactcgta

SEQ ID NO: 604166 - DNA, 495 bp, Homo sapiens
  misc_feature: HIJSMM301CE2IN.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactcgtggggtcccagacagattcagcggcagtggcactgatgtcacactgacaatcagcaggtggaggctgaggatgttgggtttggttcctccatgcaaggtacacactggccttttggccaggggaccaacctggaggattacaatgaacgtgtggctgcacatctgtctt

SEQ ID NO: 604167 - DNA, 510 bp, Homo sapiens
  misc_feature: HIJSMM301CHX4Y.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatggggacagacttcactctcaccatcatcagcctggagcctgaggatgttgcagtttattactgtcaacatcgtaccgagtggcctccgggggccactttcggcccttgggaccaaagtggatatcaaacgaactgtggctgcaccatctgtcttcta

SEQ ID NO: 604168 - DNA, 504 bp, Homo sapiens
  misc_feature: HIJSMM301BYFR4.13.3.A03.1.454.light.4.raw
tcacgtactacacgaccggtgctcgatttagagagcgtcacagggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaactcattatttacggggtcaataagcggccctcagggctttctgatcgcttctctggctccaagtctggcaacacggcctccctgacaatctctggactccaggccgaggacgaggctgatttttactgttgttcatatgcaggaaggagtgattatgtctttggaagtgggaccaaggtcacgtctggtcagccaaggccaacccactgtcactctgttccca

SEQ ID NO: 604169 - DNA, 445 bp, Homo sapiens
  misc_feature: HIJSMM301D0AGH.5.9.A09.1.454.light.4.raw
  modified_base (427)..(427): a, c, t, g, unknown or other
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagttttgggtgtttgggtgttcggcggagggaccaagctgaccgtcctaagtcagcccaaggctgccccctcggtcactctgttcccnccctcctccgtgtctgat

SEQ ID NO: 604170 - DNA, 493 bp, Homo sapiens
  misc_feature: HIJSMM301AZVUC.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgaatttcggtggagggaccaaaggtggagggtcaaacgaactgtggctgcaccatctgtctttcatt

SEQ ID NO: 604171 - DNA, 481 bp, Homo sapiens; identical to SEQ ID NO: 535993
  misc_feature: HIJSMM301D3Q4Y.21.25.C03.1.454.light.4.raw

SEQ ID NO: 604172 - DNA, 477 bp, Homo sapiens; identical to SEQ ID NO: 537931
  misc_feature: HIJSMM301B9YQP.48.5.A05.1.454.light.4.raw

SEQ ID NO: 604173 - DNA, 514 bp, Homo sapiens
  misc_feature: HIJSMM301EZ948.12.85.H08.1.454.light.4.raw
  modified_base (357)..(357): a, c, t, g, unknown or other
atacgacgtacacgaccggtgctcgatttagtatcactcagtcgcgggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttggtcgttataactttgtctcctggtacaaacagcacccaggcaaagccccccaactcctgatttatgaggtcactattcggtcctcaggaatttctaatcgcttctctggttccaagtctggcaacncggcctcctgaccatctctggggtccaggctgaggacgaggctgattattactgcagttcatatacaagcacttccactctcgtggtgttcggcggtgggaccaaggctgaccgtcctaagtcagcccaaggctcgccccctggtcactctgttccc

SEQ ID NO: 604174 - DNA, 499 bp, Homo sapiens; identical to SEQ ID NO: 536030
  misc_feature: HIJSMM301BMB00.48.23.C01.1.454.light.4.raw

SEQ ID NO: 604175 - DNA, 322 bp, Homo sapiens
  misc_feature: HIJSMM301AYI4V.49.73.G07.1.454.light.4.raw
agtcgagagacacgaccggtgctcgatttagctctacgctcagggcacgaccggtgctcgatttagagagagtgtgttgggtttggggatctacgatgtctccaatttggaaacaggggtcccatcaaggttcagtggaagtggatctgggacagattttactttcaccatcagcagcctgcagcctgaagatattgcaacatattactgtcaacagtatgataatctcccactcactttcggcggagggaccaaggtggagatcaaacgaactgtggctgcaccatctgtcttcatcttcccgccatctgatctctcgact

SEQ ID NO: 604176 - DNA, 495 bp, Homo sapiens
  misc_feature: HIJSMM301DR2P5.43.55.E11.1.454.light.4.raw
tgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaaagtggggtcccattaaggttcagcggcagtggatctgggacagagtttactctcaccatcagcagcctgcagcctgatgattttgcaacttattactgccaacatatgattcttggccgtggacgttcggccaagggaccaacgtggaaatcaaacgaactgtggctgcaccatctgtcttcatt

SEQ ID NO: 604177 - DNA, 507 bp, Homo sapiens
  misc_feature: HIJSMM301EEOGD.49.65.F10.1.454.light.4.raw
agtcgagagacacgaccggtgctcgatttagctacgctctaaggggctgggcctaaggaagcagcactggtggtgcctcagccatggcctggaccgttctcctcctcggcctcctctctcactgcacagtctctgtgacctcctatgtgctgtctcagtcaccctcggtgtcagtggccccaggacagacggccaggattacctgtgggggagacaacattggaaataaaggtgtgcactggtaccagcagatgccaggccaggcccctgtcctggtcgtctttgatgatagcgaccggccctcagggatccctgagcgattctctggctccaactctggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccgccct

SEQ ID NO: 604178 - DNA, 491 bp, Homo sapiens; identical to SEQ ID NO: 539402
  misc_feature: HIJSMM301D0236.13.5.A05.1.454.light.4.raw

SEQ ID NO: 604179 - DNA, 485 bp, Homo sapiens; identical to SEQ ID NO: 550410
  misc_feature: HIJSMM301AYJ7L.14.53.E09.1.454.light.4.raw

SEQ ID NO: 604180 - DNA, 495 bp, Homo sapiens
  misc_feature: HIJSMM301CSLAK.49.53.E09.1.454.light.4.raw
agtcgagagacacgaccggtgctcgatttagagagagtgtgttgggtttggggggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctggaaatcagacgaactgtggctgcaccatctgtt

SEQ ID NO: 604181 - DNA, 488 bp, Homo sapiens
  misc_feature: HIJSMM301CI8CM.51.35.D02.1.454.light.4.raw
cgatcgtatacacgaccggtgctcgatttagcacacgatagttgggtttgggctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgttcttcggaactgcgaccaaggtcacgtcctgggtcagcccaac

SEQ ID NO: 604182 - DNA, 496 bp, Homo sapiens; identical to SEQ ID NO: 547247
  misc_feature: HIJSMM301DGZE2.10.79.H02.1.454.light.4.raw

SEQ ID NO: 604183 - DNA, 497 bp, Homo sapiens; identical to SEQ ID NO: 534982
  misc_feature: HIJSMM301C3MI1.26.80.H03.1.454.light.4.raw

SEQ ID NO: 604184 - DNA, 486 bp, Homo sapiens; identical to SEQ ID NO: 535043
  misc_feature: HIJSMM301AVYKY.46.35.D02.1.454.light.4.raw

SEQ ID NO: 604185 - DNA, 447 bp, Homo sapiens; identical to SEQ ID NO: 535882
  misc_feature: HIJSMM301A5WG5.18.9.A09.1.454.light.4.raw
  modified_base (429)..(429): a, c, t, g, unknown or other

SEQ ID NO: 604186 - DNA, 495 bp, Homo sapiens; identical to SEQ ID NO: 539809
  misc_feature: HIJSMM301AIKE4.3.33.C11.1.454.light.4.raw

SEQ ID NO: 604187 - DNA, 492 bp, Homo sapiens
  misc_feature: HIJSMM301A59Z0.46.26.C04.1.454.light.4.raw
actagcagtacacgaccggtgctcgatttagtctagcgactttgggtttggggtgatcaggactcctcagtccaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagtattttacactagaaaatcagcagagtggaggctgaggatggttgggctctattattgcatgcaagctctaacaacgtcccgctcactttcggcggacgggaccgaaggtggagatacaaacgaa

SEQ ID NO: 604188 - DNA, 479 bp, Homo sapiens
  misc_feature: HIJSMM301AG3CD.51.78.H01.1.454.light.4.raw
cgatcgtatacacgaccggtgctcgatttagtgtgagtagtttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagagaccagggaaagcccctaacctcctgatctatgatgcacccaatttggaaagtggggtcccatcaaggttcagtggcagtggatctgggacagatttcactctcaccatcagcagtgtgcgacctgaagattttgcaacttactactgtcaacagagttacagtacccctcagctcactttcgcggagggaccaaggtggagatcaaacgaactgtggctgcacc

SEQ ID NO: 604189 - DNA, 504 bp, Homo sapiens
  misc_feature: HIJSMM301B9QIO.18.23.C01.1.454.light.4.raw
tacgagtatgcacgaccggtgctcgatttagtacacgtgattagggattgggggagtcagacccagtcaggacacagcatggacacgagggtcccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaagctgcagatgacttggtccgtccagtttccaagatggggccccatcgagattccgcgtcagtggatctgggacagatttcactctcaccatcagcagcctgcagcctgaagattttgcaacttactattgtctagcaggcgcacaatttcccgctcactttcggcggtagggaccaaggtggagatcaaacgaactgtggctgcaccatctgtcttcatcttccccg

SEQ ID NO: 604190 - DNA, 494 bp, Homo sapiens; identical to SEQ ID NO: 534992
  misc_feature: HIJSMM301ATK7B.9.1.A01.1.454.light.4.raw

SEQ ID NO: 604191 - DNA, 498 bp, Homo sapiens
  misc_feature: HIJSMM301CP39T.5.24.C02.1.454.light.4.raw
atcagacacgcacgaccggtgctcgatttagtacagatcgttagggaaagggggctggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaaggctgaccgtcctagggtcagccc

SEQ ID NO: 604192 - DNA, 508 bp, Homo sapiens
  misc_feature: HIJSMM301DHOYX.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggcccggggaccaaagtggaaatcaaacgaactgtggctgcaccatctgtcttcatccttcccgcc

SEQ ID NO: 604193 - DNA, 495 bp, Homo sapiens
  misc_feature: HIJSMM301EDG2N.15.59.F04.1.454.light.4.raw
tctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtgctggcatttcggtctttcggcggagggaccaagctgaccgtcctaggtcagcccaaggctgccccctcggtcactctgttcccaccctcctcgctacgtaga

SEQ ID NO: 604194 - DNA, 516 bp, Homo sapiens
  misc_feature: HIJSMM301BH14M.51.27.C05.1.454.light.4.raw
cgatcgtatacacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaggcaaagcccccaaactcatgatttatgatgtcagtgatcggccctcaggggtttcgaatcgcttctctggctccaagtccggcaacacggcctccctgaccatctctgggctccaggccgaggacgaggctgattattactgcacctcatatacaagcagcaacaattgggtgttcggcggagggaccaagctgaccgtcctaggtcagcccaaggctgccccctggtcactctgttccccg

SEQ ID NO: 604195 - DNA, 407 bp, Homo sapiens
  misc_feature: HIJSMM301BEDCX.43.24.C02.1.454.light.4.raw
tgtgagtagtcacgaccggtgctcgatttagtacagatcgttagggaaaggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggttcagtggcagtggatcaggcacagattttacactgaaaatcagcagagtggaggctgaggatgttggggtttattactgcatgcaagctctacaaactccgctcactttcggcggagggaccaaggtggagatcaaacgaactgtggctgcaccatctgtcttcatcttccgccatctgaactactcaca

SEQ ID NO: 604196 - DNA, 501 bp, Homo sapiens
  misc_feature: HIJSMM301CS53U.43.53.E09.1.454.light.4.raw
tgtgagtagtcacgaccggtgctcgatttagagagagtgtgttggggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcccccctgacaatctctgggctccaggctgaggacgaggctgattattattgctgctcatatgcaggtagttacacttatgtcttcggaattgggacgacggtcaccgtcctaggtcagcccaaggccaacccca

SEQ ID NO: 604197 - DNA, 500 bp, Homo sapiens
  misc_feature: HIJSMM301DCNA1.4.72.G06.1.454.light.4.raw
agcactgtagcacgaccggtgctcgatttagctacgactgcaagggaaagggggaggaactgctcagttaggacccagacggaaccatggaagccccagcgcagcttctcttcctcctgctactctggctcccagaaagcagtggagaagtagtgatgacgcagtctccagccaccctgcctgtgtctccaggggacactgccaccctctcctgcagggccagtcagagtgttggcactaatttagcctggtaccagcagaaacctggccaagctcccaggctgctcatctataatacaatcacaagggacattggtgtcccagacaggttcagcggcagtgggtctgggacagagttcactctcactatcagcagcctgcactttgaagattttgcagtctatcattgtcagcagtataattggtggcctcggacgttcggtccaagggaccgaacggtggaaagtacaaacgaacctagtggcgtgcaccactcttcg

SEQ ID NO: 604198 - DNA, 488 bp, Homo sapiens
  misc_feature: HIJSMM301B2AIG.17.25.C03.1.454.light.4.raw
cgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacagttcccctcgcacttttggccagggaccaaagttgagatcaaacgaactgtggctgcaccatctgtt

SEQ ID NO: 604199 - DNA, 502 bp, Homo sapiens; identical to SEQ ID NO: 558619
  misc_feature: HIJSMM301DUZYQ.5.86.H09.1.454.light.4.raw

SEQ ID NO: 604200 - DNA, 501 bp, Homo sapiens
  misc_feature: HIJSMM301A8582.41.35.D02.1.454.light.4.raw
tctatactatcacgaccggtgctcgatttagcacacgatagttgggtttggggggggtcacaagaggcagcgctctcgtgacgtctccaccatggcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctgatcgcttctctggctccaagtctggcaatacggcctccctgacagtctctcggctccaggcggaggacgaggctgattactactgcttctcatatgcagatactaagtcctgggtgttcggcggagggaccaagctgaccgtcctaggtcagcccaaggctgccccctc

SEQ ID NO: 604201 - DNA, 476 bp, Homo sapiens
  misc_feature: HIJSMM301EI8Y7.51.53.E09.1.454.light.4.raw
cgatcgtatacacgaccggtgctcgatttagagagagtgtgttgggtttgggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggcgggggaccgaaggtggagatcaagacgaactgtgg

SEQ ID NO: 604202 - DNA, 511 bp, Homo sapiens; identical to SEQ ID NO: 537464
  misc_feature: HIJSMM301BDR2J.7.34.D01.1.454.light.4.raw

SEQ ID NO: 604203 - DNA, 477 bp, Homo sapiens; identical to SEQ ID NO: 565404
  misc_feature: HIJSMM301B615G.7.76.G10.1.454.light.4.raw

SEQ ID NO: 604204 - DNA, 505 bp, Homo sapiens; identical to SEQ ID NO: 543540
  misc_feature: HIJSMM301CWG9E.9.12.B01.1.454.light.4.raw

SEQ ID NO: 604205 - DNA, 502 bp, Homo sapiens
  misc_feature: HIJSMM301CY0BF.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactatttacctcaagtgatcaccttcggccaagggacacgactggagattaaacg

SEQ ID NO: 604206 - DNA, 494 bp, Homo sapiens; identical to SEQ ID NO: 534992
  misc_feature: HIJSMM301CEZ7H.9.1.A01.1.454.light.4.raw

SEQ ID NO: 604207 - DNA, 495 bp, Homo sapiens
  misc_feature: HIJSMM301ERREN.51.71.G05.1.454.light.4.raw
cgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgattattattgtcaatcaacagacaccattggtacttatgtcttcggaactgcgaccaaggtcaccgtcctgggtcagcccaaggccaaccccactgtcta

SEQ ID NO: 604208 - DNA, 494 bp, Homo sapiens
  misc_feature: HIJSMM301EJLD8.9.1.A01.1.454.light.4.raw
tgatacgtctcacgaccggtgctcgatttagacgtctcatcagggggaggctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttcccg

SEQ ID NO: 604209 - DNA, 486 bp, Homo sapiens; identical to SEQ ID NO: 568099
  misc_feature: HIJSMM301D1N9C.26.45.E01.1.454.light.4.raw

SEQ ID NO: 604210 - DNA, 518 bp, Homo sapiens
  misc_feature: HIJSMM301CA7HF.49.10.A10.1.454.light.4.raw
agtcgagagacacgaccggtgctcgatttagcgtcgatctcaggggagtctgggcctaaggaagcagcactggtggtgcctcagccatggcctggaccgttctcctcctcggcctcctctctcactgcacagactctgtgacctcctatgttctgactcagccgccctcggcgtcagtggccccaggacagacggccacgattccctgtaggggagacgacattggagggaaagctgtgcattggtaccagcagaagccaggccaggcccctgagctggtcctccatggtgatagcgaccggccctcaggaatccctgagagattctccggctccaactctggggagatggccaccctgactattaccagggccgaagccggggatgaggccgactattactgtcaggtgtgggatagtgatacggaccatagggtgttcggcggagggaccaaggtgaccgtcctaggtcagcccaaggctgccccctggtccactctcgttcccgccctcctctct

SEQ ID NO: 604211 - DNA, 480 bp, Homo sapiens; identical to SEQ ID NO: 535442
  misc_feature: HIJSMM301EZFB5.41.17.B06.1.454.light.4.raw

SEQ ID NO: 604212 - DNA, 494 bp, Homo sapiens; identical to SEQ ID NO: 534994
  misc_feature: HIJSMM301EBIOO.27.78.H01.1.454.light.4.raw

SEQ ID NO: 604213 - DNA, 502 bp, Homo sapiens; identical to SEQ ID NO: 581170
  misc_feature: HIJSMM301AVZE1.15.1.A01.1.454.light.4.raw

SEQ ID NO: 604214 - DNA, 516 bp, Homo sapiens
  misc_feature: HIJSMM301B7MWQ.10.26.C04.1.454.light.4.raw
catagtagtgcacgaccggtgctcgattagtctagcgactttgggtttgggggctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttcatcttcccgcca

SEQ ID NO: 604215 - DNA, 478 bp, Homo sapiens
  misc_feature: HIJSMM301EEAA3.3.20.B09.1.454.light.4.raw
agacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcgtctatttaaattggtatcagcacaaaccagggaaagcccctaagctcctgatctatgctgaatccactttgcaaagtggggtcccatcaaggttcagtggcagtggatctgggacagatttcactctaaccatcagcggtctgtaacctgaagattttgcaactcactactgtcaacagagtgacagcacgcctcacactttcggcggagggaccaaggtggaggatcaaacgaactgtggctgca

SEQ ID NO: 604216 - DNA, 485 bp, Homo sapiens
  misc_feature: HIJSMM301BEJSZ.48.53.E09.1.454.light.4.raw
agtatacatacacgaccggtgctcgatttagagagagtgtgttgggtttggggggagaagagctgctcagttaggacccagagggaaccatggaaaccccagcgcagcttctcttcctcctgctactctggctcccagataccaccggagcacttgtgttgacgcagtctccaggcaccctgtctttgtctccaggggagagagccaccctctcctgcagggccagtcagagtgttagcggcggctccgtagcctggtaccagcagaaacgtggccaggttcccaggctcctcatctatgatgcatccagcagggccactggcatcccagacaggttcaggtggcaggtgggtctgggacagacttcactctcaccatcagcagactggagcctgaagtatttgcagtgtattactgtcagcagtatggtagctcacctcaactctactttcggcggagggaccgaaggtggagatacaaacgaa

SEQ ID NO: 604217 - DNA, 513 bp, Homo sapiens
  misc_feature: HIJSMM301ENE9G.9.33.C11.1.454.light.4.raw
tgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctcgggaccaaaattagagatcaaacgaactagtggctgcaccatctgtcttctatcttcccg

SEQ ID NO: 604218 - DNA, 497 bp, Homo sapiens
  misc_feature: HIJSMM301CE2ZM.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgttcggtccaagggaccgaaggtacggaagtacaaacgaactagtggctgcaccatctgtctt

SEQ ID NO: 604219 - DNA, 489 bp, Homo sapiens; identical to SEQ ID NO: 535139
  misc_feature: HIJSMM301EODPP.14.55.E11.1.454.light.4.raw

SEQ ID NO: 604220 - DNA, 517 bp, Homo sapiens; identical to SEQ ID NO: 573668
  misc_feature: HIJSMM301C1GCC.43.81.H04.1.454.light.4.raw

SEQ ID NO: 604221 - DNA, 447 bp, Homo sapiens
  misc_feature: HIJSMM301A3DJM.14.76.G10.1.454.light.4.raw
cgtctagtaccacgaccggtgctcgatttagtcactcatacagggtccgtgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctcggtcactcctgttccccaccctcctcgtactagacg

SEQ ID NO: 604222 - DNA, 514 bp, Homo sapiens; identical to SEQ ID NO: 541502
  misc_feature: HIJSMM301BT2I1.15.34.D01.1.454.light.4.raw

SEQ ID NO: 604223 - DNA, 489 bp, Homo sapiens
  misc_feature: HIJSMM301AEMJG.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattacttgccaacagtataatggttatgaatccacttttggccaggaccaagctggagatcaaacgaactatggctgcaccta

SEQ ID NO: 604224 - DNA, 479 bp, Homo sapiens
  misc_feature: HIJSMM301D0T1W.18.76.G10.1.454.light.4.raw
  modified_base (422)..(422): a, c, t, g, unknown or other
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaacagggacagcccctaagctcctaatctacgatgcgtctcatttgcagacagggtcccaccaaggttcagcggaagtggatcgtgggacagtattttaatttcaccatcagcagcctccaacgtgatgatgttgcaacatactattgtcagcaatatgtattttnctcctccgagtgcctacttttgggcggggggaccgaaggtggacatacaaacgaact

SEQ ID NO: 604225 - DNA, 516 bp, Homo sapiens; identical to SEQ ID NO: 552129
  misc_feature: HIJSMM301A8K8D.27.23.C01.1.454.light.4.raw

SEQ ID NO: 604226 - DNA, 447 bp, Homo sapiens; identical to SEQ ID NO: 535020
  misc_feature: HIJSMM301CMZ1B.18.9.A09.1.454.light.4.raw

SEQ ID NO: 604227 - DNA, 502 bp, Homo sapiens
  misc_feature: HIJSMM301C5ZTT.3.4.A04.1.454.light.4.raw
agacgcactccacgaccggtgctcgatttagagtagtgatcaggggtgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctccgacgttcggccacgggaccaaggtaggaaatcaaacgaaactgtggctgcaccatctgtcttc

SEQ ID NO: 604228 - DNA, 512 bp, Homo sapiens
  misc_feature: HIJSMM301EKBA9.17.28.C06.1.454.light.4.raw
cgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatccggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctcgccccccg

SEQ ID NO: 604229 - DNA, 416 bp, Homo sapiens; identical to SEQ ID NO: 539343
  misc_feature: HIJSMM301C9CLQ.18.78.H01.1.454.light.4.raw

SEQ ID NO: 604230 - DNA, 509 bp, Homo sapiens
  misc_feature: HIJSMM301A8N3H.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcagtgggcccaagtggaggatgaagctgactactactgttactcaatagagaacagtgataatttctgggtgttcggcggagggaccaaactgaccgtcctaggtcagcccaaggctgccccctggtcactctgtttccccg

SEQ ID NO: 604231 - DNA, 484 bp, Homo sapiens
  misc_feature: HIJSMM301ECKCS.10.53.E09.1.454.light.4.raw
catagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttattcagctccgacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgcggcagtttatactgtcagcactattatagtaccccattcacattcggccctgggaccaaagtggagatcaaacga

SEQ ID NO: 604232 - DNA, 488 bp, Homo sapiens; identical to SEQ ID NO: 563696
  misc_feature: HIJSMM301ERYHA.48.53.E09.1.454.light.4.raw

SEQ ID NO: 604233 - DNA, 480 bp, Homo sapiens
  misc_feature: HIJSMM301C0V1M.41.35.D02.1.454.light.4.raw
tctatactatcacgaccggtgctcgatttagcacacgatagttgggtttggggctccaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacagctacaatgttggcaacgaaggagcagcttggctgcagcagtaccagggccaccctcccaaattgctatcatacaggaagaacaaccgcccctcggggatctccgagagattctctgcatcaacgtcaggaaacatagcctccctgaccattactggactccagcctgaggacgaggctgactattactgctcagcatgggacagcagcctcaatgtttgggtgttcggcggagggaccaagctgaccgtcct

SEQ ID NO: 604234 - DNA, 502 bp, Homo sapiens; identical to SEQ ID NO: 541345
  misc_feature: HIJSMM301BVS1V.21.22.B11.1.454.light.4.raw
  modified_base (429)..(429): a, c, t, g, unknown or other

SEQ ID NO: 604235 - DNA, 505 bp, Homo sapiens; identical to SEQ ID NO: 535503
  misc_feature: HIJSMM301A4NE5.8.28.C06.1.454.light.4.raw

SEQ ID NO: 604236 - DNA, 490 bp, Homo sapiens
  misc_feature: HIJSMM301D6VLS.8.53.E09.1.454.light.4.raw
ctcgcgtgtccacgaccggtgctcgatttagagagagtgtgttgggtttgggggcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcgcggcgggaccaagttgaccgtcctacg

SEQ ID NO: 604237 - DNA, 491 bp, Homo sapiens
  misc_feature: HIJSMM301B08M3.51.35.D02.1.454.light.4.raw
  modified_base (467)..(467): a, c, t, g, unknown or other
cgatcgtatacacgaccggtgctcgatttagcacacgatagttgggtttggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtccngggtcagcccaaggccaacccact

SEQ ID NO: 604238 - DNA, 469 bp, Homo sapiens; identical to SEQ ID NO: 545843
  misc_feature: HIJSMM301DG9VK.7.81.H04.1.454.light.4.raw

SEQ ID NO: 604239 - DNA, 485 bp, Homo sapiens; identical to SEQ ID NO: 540285
  misc_feature: HIJSMM301B2RFY.46.26.C04.1.454.light.4.raw

SEQ ID NO: 604240 - DNA, 498 bp, Homo sapiens
  misc_feature: HIJSMM301AI6V0.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggtcggagggaccaagctgaccgtcctaggtcagcccaaggctgccccctcggtcactctcgttcccgccctcctcgagtgcgtct

SEQ ID NO: 604241 - DNA, 489 bp, Homo sapiens; identical to SEQ ID NO: 535139
  misc_feature: HIJSMM301BQD9M.14.55.E11.1.454.light.4.raw

SEQ ID NO: 604242 - DNA, 502 bp, Homo sapiens; identical to SEQ ID NO: 543936
  misc_feature: HIJSMM301CKHZW.15.1.A01.1.454.light.4.raw

SEQ ID NO: 604243 - DNA, 486 bp, Homo sapiens; identical to SEQ ID NO: 537310
  misc_feature: HIJSMM301DZ37E.15.28.C06.1.454.light.4.raw

SEQ ID NO: 604244 - DNA, 489 bp, Homo sapiens; identical to SEQ ID NO: 535091
  misc_feature: HIJSMM301BY3VC.47.36.D03.1.454.light.4.raw

SEQ ID NO: 604245 - DNA, 496 bp, Homo sapiens; identical to SEQ ID NO: 544216
  misc_feature: HIJSMM301DEPSE.18.11.A11.1.454.light.4.raw

SEQ ID NO: 604246 - DNA, 463 bp, Homo sapiens; identical to SEQ ID NO: 545937
  misc_feature: HIJSMM301D26JO.17.28.C06.1.454.light.4.raw

SEQ ID NO: 604247 - DNA, 489 bp, Homo sapiens; identical to SEQ ID NO: 553430
  misc_feature: HIJSMM301BJ3I3.14.55.E11.1.454.light.4.raw

SEQ ID NO: 604248 - DNA, 471 bp, Homo sapiens
  misc_feature: HIJSMM301CXO56.3.82.H05.1.454.light.4.raw
agacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaagcccctgagttcctgatgtctgctgcatccaccctgcaaagtggagtcccatccagattcagcgtcagtgaatctgggacagagttcactctcaccatcagcagcctgcagcctgaagtattttgctaacttactattgtcaacaggctgacagtctcccgctcactttcggcggaggaccgaaggtggagatcaaacgaa

SEQ ID NO: 604249 - DNA, 358 bp, Homo sapiens
  misc_feature: HIJSMM301BND3I.40.11.A11.1.454.light.4.raw
tctagcgactcacgaccggtgctcgatttagctacgactgcagggaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtcttttatacaactccaacaagcagcactacttagcttggtaccagcagaaaccaggacagcctcctaaactgctcatttactgggcctctacccgggaatccggggtccctgaccgattcagtggcagcgggtctgggacagacttcactctcacca

SEQ ID NO: 604250 - DNA, 520 bp, Homo sapiens; identical to SEQ ID NO: 537173
  misc_feature: HIJSMM301BZH4Y.27.23.C01.1.454.light.4.raw

SEQ ID NO: 604251 - DNA, 490 bp, Homo sapiens
  misc_feature: HIJSMM301B9JGQ.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgcagtttattactgtcagcagtataatgactgggtttattcactttcgccctgggaccaaagtggatttcagacgaactgtggctgcaccatctgtcttcta

SEQ ID NO: 604252 - DNA, 478 bp, Homo sapiens
  misc_feature: HIJSMM301CM6QA.40.10.A10.1.454.light.4.raw
tctagcgactcacgaccggtgctcgatttagcgtcgatctcagggggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggtccagggaccgaaagtggatgtcaaccgaactagtggctgcacca

SEQ ID NO: 604253 - DNA, 496 bp, Homo sapiens; identical to SEQ ID NO: 535109
  misc_feature: HIJSMM301B5U2S.16.78.H01.1.454.light.4.raw

SEQ ID NO: 604254 - DNA, 493 bp, Homo sapiens
  misc_feature: HIJSMM301DK076.13.10.A10.1.454.light.4.raw
tcacgtactacacgaccggtgctcgatttagcgtcgatctcaggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttggaacaaagctgcccttatcatcacggggcccaggcagaagatgaatctgattattactgtgttctttatatggtagtgccatttctgctgtgttcggaggaggcacccggctgaccgtcctcggtcagcccaaggctgcccc

SEQ ID NO: 604255 - DNA, 508 bp, Homo sapiens
  misc_feature: HIJSMM301DXCAX.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagcctacgaccgtcgtggtcgacgaccgagtctccgccccgtcgtct

SEQ ID NO: 604256 - DNA, 494 bp, Homo sapiens
  misc_feature: HIJSMM301ALZ9A.16.10.A10.1.454.light.4.raw
tgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagaggccctcagggatccctgggcgattctctggctccagctcagggacgacagtcacgttgaccatcggtggagtccaggcagaagacgagggtgactattactgtcagtctgcaaacaccactgcagcggtgttcggcggagggaccaagctgaccgtcctgcgtcagcccaaggctgccccctggtcactctgttcccg

SEQ ID NO: 604257 - DNA, 505 bp, Homo sapiens
  misc_feature: HIJSMM301D6QBT.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggtaggaccaagctgaccgtctgggtcagcccaaggctcgccccctcggtctac

SEQ ID NO: 604258 - DNA, 486 bp, Homo sapiens; identical to SEQ ID NO: 535043
  misc_feature: HIJSMM301B0SP4.46.35.D02.1.454.light.4.raw

SEQ ID NO: 604259 - DNA, 506 bp, Homo sapiens
  misc_feature: HIJSMM301ETVEU.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactacctttacctcaagtgatcaccttcggaccaagggacacgactggagattaaaacg

SEQ ID NO: 604260 - DNA, 509 bp, Homo sapiens; identical to SEQ ID NO: 553073
  misc_feature: HIJSMM301DHYRO.16.1.A01.1.454.light.4.raw

SEQ ID NO: 604261 - DNA, 489 bp, Homo sapiens
  misc_feature: HIJSMM301B05QR.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatcgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggcctaggggaccaagctggagatcaaacgaactgtggctgcaccact

SEQ ID NO: 604262 - DNA, 500 bp, Homo sapiens
  misc_feature: HIJSMM301CAN6R.22.9.A09.1.454.light.4.raw
  modified_base (491)..(491): a, c, t, g, unknown or other
acatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccgtctaccgtgcaagggtccaatgagagtattagcgactacttagcctggtaccaacagaggcctggccaggctcccaggctcctcatgtatgatgcttccaaaagggccactggcatcccagccaggttcagtggcagtgggtctggaagagacttcactctcaccatcaacagcctagagcctgacgattctgcagtttattactgtcagcagcgtaccaagtggcctccgcttttggccagggggccaagctggagatcagacgaactgtggctgcaccatctgtcttcntcttccccg

SEQ ID NO: 604263 - DNA, 475 bp, Homo sapiens; identical to SEQ ID NO: 545253
  misc_feature: HIJSMM301CB31A.51.67.G01.1.454.light.4.raw

SEQ ID NO: 604264 - DNA, 512 bp, Homo sapiens
  misc_feature: HIJSMM301DI58E.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctggtcactctgttcccacctcct

SEQ ID NO: 604265 - DNA, 499 bp, Homo sapiens
  misc_feature: HIJSMM301A3W3I.10.37.D04.1.454.light.4.raw
catagtagtgcacgaccggtgctcgatttagtagcatactgttgggtttgggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaagcctggccaggttcccagactcctcatatatgaagcctcttccagggccactggagtcccagccaggttcagcggcggtgggtctgggacagacttcactctcaccatcagcagcctgcagtctgaggaccttggagtttattactgtcagcagtatcataactggcctccgtggacgttcggccaagggaccaaggtggacctcaaacgaactgtggctgcaccatctgtcttcta

SEQ ID NO: 604266 - DNA, 510 bp, Homo sapiens
  misc_feature: HIJSMM301CE2GY.49.78.H01.1.454.light.4.raw
agtcgagagacacgaccggtgctcgatttagtgtgagtagtttgggtttggggtgggtccaggaggcagaactctgggtgtctcaccatggcctggatccctctacttctccccctcctcactctctgcacaggctctgaggcctcctatgagttgatccagccaccctcggtgtcagtgtccccaggacagacggccaggattctttgctctggagatgcgttggcaaaacagtttgcttattggttccagcagaagccaggccaagcccctgtggtggtgatttataaaggctttcagaggccctcagggatccctgagcgattctctgggtccagctcagggacaacagccatgttgaccatcagtggagtccaggcagaagacgaggctgactattattgtcaatcagcagacaacactgttgtttctgtgtttttcggcggtcgggaccaggctgaccgtcctgggtcagccaaggctgcccctcggtcactctgttcccaccct

SEQ ID NO: 604267 - DNA, 494 bp, Homo sapiens
  misc_feature: HIJSMM301BMPM8.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgctagtttattactgtcagcagtataatgacttgggttttattcactttcggccctgggaccaaagtggatttcagacgaactgtggctgcaccatctgtcttcta

SEQ ID NO: 604268 - DNA, 516 bp, Homo sapiens; identical to SEQ ID NO: 535549
  misc_feature: HIJSMM301A19YS.14.70.G04.1.454.light.4.raw

SEQ ID NO: 604269 - DNA, 497 bp, Homo sapiens; identical to SEQ ID NO: 538030
  misc_feature: HIJSMM301EDKFZ.40.23.C01.1.454.light.4.raw

SEQ ID NO: 604270 - DNA, 510 bp, Homo sapiens
  misc_feature: HIJSMM301AXRF7.22.36.D03.1.454.light.4.raw
acatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccactcatcattatggtgtcactcgtcggccctcaggagtctctcatcgcttctcaggctccaagtctggcaacacggcctccctaaccatctctgggctccagtttgaggacgagtctacttattactgcagttcctttaaattaggcgccactctcgtggttttcggcggaggcaccgaagtgaccgtcctcggtcagcccaaggctgccccctcggtcact

SEQ ID NO: 604271 - DNA, 482 bp, Homo sapiens
  misc_feature: HIJSMM301ER4RJ.41.68.G02.1.454.light.4.raw
tctatactatcacgaccggtgctcgatttagtcgatagtgaagggaaagggggcaggagtcagtcccaaccaggacacagcatggacatgagggtccctgctcagctcctggggctcctgctgctctggctctcaggtgccagatgtgacatccagatgacccagtctccaacctccctgtctgcatctgtaggagacagagtcaccatcacttgccaggccagtcaggacattagcaactatttaaattggtatcagcagaaaccagggaaagcccctaagctcctgatctacgatgcatccaatttggaatcagggtcccatcaaggttcagtggaagtggatctgggacagattttactttcaccatcaccagcctgcagcctgaagatattgcaacatattactgtcaacagtatgataatctccctcccactttcggcggaggaccgaaggtggagatcaaacgaactgtggctgca

SEQ ID NO: 604272 - DNA, 514 bp, Homo sapiens
  misc_feature: HIJSMM301DDG1W.48.53.E09.1.454.light.4.raw
agtatacatacacgaccggtgctcgatttagagagagtgtgttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctcgccccctcggtcactctcgttcccgccct

SEQ ID NO: 604273 - DNA, 496 bp, Homo sapiens
  misc_feature: HIJSMM301AX8CH.53.10.A10.1.454.light.4.raw
cgcgtatacacacgaccggtgctcgatttagcgtcgatctcaggggctgggcctcaggaagcagcatcggaggtgcctcagccatggcatggatccctctcttcctcggcgtccttgcttactgcacaggatccgtggcctcctatgagttgactcagccaccctcctgtccgtgtccccaggacagacagccaccatcacttgttctggagataaactggagaccaagtatatttgttggtatcaacagaggccaggcctgtcccctctgttggtcatgtatcaagataacaagcggccctctggcatccctgggcgattctctggctccaactctgggaacacagccactctgaccatcagcgggacccagactatggatgaggctgactattactgtcaggcatgggacagcgaaattgcggtgttcggcgggggaccgaactgaccgtcctaggtcagcccaaggctgccccctcggtcactctgttcccgt

SEQ ID NO: 604274 - DNA, 508 bp, Homo sapiens; identical to SEQ ID NO: 541821
  misc_feature: HIJSMM301C9F6Q.5.60.F05.1.454.light.4.raw

SEQ ID NO: 604275 - DNA, 501 bp, Homo sapiens
  misc_feature: HIJSMM301D4E92.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggtccaaggaccgagggtaggaaagtacaaacgaaactagtggctgcaccatctgtcttcatt

SEQ ID NO: 604276 - DNA, 473 bp, Homo sapiens; identical to SEQ ID NO: 535262
  misc_feature: HIJSMM301CQDES.8.67.G01.1.454.light.4.raw

SEQ ID NO: 604277 - DNA, 510 bp, Homo sapiens
  misc_feature: HIJSMM301B6SE9.5.60.F05.1.454.light.4.raw
atcagacacgcacgaccggtgctcgatttagtacgtcatcagggaaaggggcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcacctcagcctccctggccatccgtgggctccagtctgaggatgagtctgattattactgtgcaacatgggatgacagcctgaatggtccggtattcggcggagggaccaagctgaccgtcctcggtcagcccaaggcctgccccccg

SEQ ID NO: 604278 - DNA, 515 bp, Homo sapiens
  misc_feature: HIJSMM301CFR6W.52.29.C07.1.454.light.4.raw
cgcagtacgacacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttataattctgtctcctggtaccaacaatacccggcaaagtcccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacagaaacacttgggtgttcggcggcgggaccaaactgaccgtcctacgtcagcccaaggctgccccctcggtcactctgttccccg

SEQ ID NO: 604279 - DNA, 465 bp, Homo sapiens; identical to SEQ ID NO: 547936
  misc_feature: HIJSMM301EJ1GH.26.78.H01.1.454.light.4.raw

SEQ ID NO: 604280 - DNA, 521 bp, Homo sapiens
  misc_feature: HIJSMM301DTBP8.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggcccactggcaccccagacaggatcagtggcagcgggtctgggacagacttcattctcaccatcaacagactgcagcctgaagatattgcagtttactactgtcagcagtatgttacgtccccgtggacgtcggccgaagggacaaggtggcgaatcaaccgaactgtggctgcaccatctgtcttcattccttccccg

SEQ ID NO: 604281 - DNA, 503 bp, Homo sapiens; identical to SEQ ID NO: 538884
  misc_feature: HIJSMM301DRB71.27.78.H01.1.454.light.4.raw

SEQ ID NO: 604282 - DNA, 495 bp, Homo sapiens; identical to SEQ ID NO: 603773
  misc_feature: HIJSMM301BLGBW.22.57.F02.1.454.light.4.raw

SEQ ID NO: 604283 - DNA, 513 bp, Homo sapiens
  misc_feature: HIJSMM301B0E8X.8.42.D09.1.454.light.4.raw
ctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctcgcccctcggtcactctcgttcccaccctcccg

SEQ ID NO: 604284 - DNA, 495 bp, Homo sapiens
  misc_feature: HIJSMM301DMEH6.47.64.F09.1.454.light.4.raw
agctcacgtacacgaccggtgctcgatttagcgcgtatacaagggggaggaacgtgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctggggacagacttcactctcaccatcagcagcctagagcctgaagactttggactttattactgtcagcagcgtgagttctggcctccgctcactttcggcggagggaccagggtggagatcaaacgaactgtggctgcaccatctgtcttcatt

SEQ ID NO: 604285 - DNA, 463 bp, Homo sapiens; identical to SEQ ID NO: 535062
  misc_feature: HIJSMM301BJG3R.11.73.G07.1.454.light.4.raw

SEQ ID NO: 604286 - DNA, 495 bp, Homo sapiens; identical to SEQ ID NO: 543094
  misc_feature: HIJSMM301D0U5Q.22.57.F02.1.454.light.4.raw

SEQ ID NO: 604287 - DNA, 498 bp, Homo sapiens; identical to SEQ ID NO: 558294
  misc_feature: HIJSMM301DVP4T.26.26.C04.1.454.light.4.raw

SEQ ID NO: 604288 - DNA, 484 bp, Homo sapiens
  misc_feature: HIJSMM301BVZ6V.41.47.E03.1.454.light.4.raw
tctatactatcacgaccggtgctcgatttagactcgcgcacagagagaaggggtgatcaggactcctcagttcaccttctcacaatgaggctccctgctcagctcctggggctgctaatgctctgggtctctggatctagtggagagattgtgatgagtcagtctccacgctccctgtccgtcacccctggagagtcggcctccatctcctgcaagtcgagtcacaacctcctgtatagtaatggatacaattatgtggattggtacgtgcagaagccagggcagtctccacaactcctcatctatttgggttctcatcgggactccggggtccctgacaggttcactggcagtggttcaggcacagattttaccctagaaatcagtagagtggaggctgaggatgttggcgactattactgcctgcaagctcggcaattcccgatcaccttcggccccgggacacgactggacattaaacgaa

SEQ ID NO: 604289 - DNA, 500 bp, Homo sapiens
  misc_feature: HIJSMM301BVYO1.22.27.C05.1.454.light.4.raw
acatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctcctcagacgttcggccaagggaccaagtggaaatcaaacgaactagtggctgcaccta

SEQ ID NO: 604290 - DNA, 485 bp, Homo sapiens; identical to SEQ ID NO: 536576
  misc_feature: HIJSMM301DVT1B.46.35.D02.1.454.light.4.raw

SEQ ID NO: 604291 - DNA, 520 bp, Homo sapiens; identical to SEQ ID NO: 546048
  misc_feature: HIJSMM301EAS7P.27.23.C01.1.454.light.4.raw

SEQ ID NO: 604292 - DNA, 508 bp, Homo sapiens
  misc_feature: HIJSMM301BI4XL.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatggttggggtttattactgcatgcaaactacacacggccgctcactttcggcggagggaccgaaggtggagatcaaacgaactgtggctgcaccatctgtt

SEQ ID NO: 604293 - DNA, 507 bp, Homo sapiens; identical to SEQ ID NO: 579844
  misc_feature: HIJSMM301BDQ2Q.11.57.F02.1.454.light.4.raw

SEQ ID NO: 604294 - DNA, 504 bp, Homo sapiens; identical to SEQ ID NO: 562026
  misc_feature: HIJSMM301B03PD.9.71.G05.1.454.light.4.raw

SEQ ID NO: 604295 - DNA, 514 bp, Homo sapiens; identical to SEQ ID NO: 541502
  misc_feature: HIJSMM301CL9IV.15.34.D01.1.454.light.4.raw

SEQ ID NO: 604296 - DNA, 487 bp, Homo sapiens
  misc_feature: HIJSMM301C1IJP.14.53.E09.1.454.light.4.raw
cgtctagtaccacgaccggtgctcgatttagagagagtgtgttgggtttgggggggaggcctagctgtgctgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggttaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcgagggaccaagctgaccgtccta

SEQ ID NO: 604297 - DNA, 486 bp, Homo sapiens; identical to SEQ ID NO: 535385
  misc_feature: HIJSMM301BJYC0.19.71.G05.1.454.light.4.raw

SEQ ID NO: 604298 - DNA, 506 bp, Homo sapiens; identical to SEQ ID NO: 539322
  misc_feature: HIJSMM301BG6IS.8.28.C06.1.454.light.4.raw

SEQ ID NO: 604299 - DNA, 495 bp, Homo sapiens
  misc_feature: HIJSMM301CEVHV.22.9.A09.1.454.light.4.raw
acatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtgggtctggaagagacttcactctcaccatcaacagcctagagcctgacgattctgcagtttattactgtcagcagcgtaccaagtggcctccgactttggccaggggccaagctggagatcagacgaactgtggctgcaccatctgtcttcatcttccccg

SEQ ID NO: 604300 - DNA, 505 bp, Homo sapiens
  misc_feature: HIJSMM301BSYIL.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccaccctgaccatcagcgcggtcgaagccggagatgaggccgactattactgtcaggtgtgggacagtaatagtgatcccgagcaggttttcggcggtgggaccaagctgaccgtcctaagtcagcccaagctgcccctccgtcgactct

SEQ ID NO: 604301 - DNA, 503 bp, Homo sapiens; identical to SEQ ID NO: 537970
  misc_feature: HIJSMM301DAENH.10.39.D06.1.454.light.4.raw

SEQ ID NO: 604302 - DNA, 498 bp, Homo sapiens; identical to SEQ ID NO: 549755
  misc_feature: HIJSMM301AYXVH.11.60.F05.1.454.light.4.raw

SEQ ID NO: 604303 - DNA, 504 bp, Homo sapiens
  misc_feature: HIJSMM301DFYQ9.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaatttcccaggattcggccccccgactcctcatctatagaaatgatcatcggccctccggggtccctgaccgattctctggctccatgtctggcacctcagcctccctgaccatcagtgggctccggtccgaggatgaggctgattattactgttgcaccgtgggatgacatcctgaatggtccggtgttcggcggagggccaggctgaccgtcctaagtcagcccaaggctg

SEQ ID NO: 604304 - DNA, 501 bp, Homo sapiens
  misc_feature: HIJSMM301A4R6Z.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctcctgacaatctctgggctccaggctgacgacgaggctaattattactgctgctcatatgaaggttataacactatactattcggcggagggaccaagctgaccgtcctgcgtcagcccaaggctgccccctcggtcactt

SEQ ID NO: 604305 - DNA, 496 bp, Homo sapiens; identical to SEQ ID NO: 537925
  misc_feature: HIJSMM301DF4WC.22.14.B03.1.454.light.4.raw

SEQ ID NO: 604306 - DNA, 484 bp, Homo sapiens; identical to SEQ ID NO: 535400
  misc_feature: HIJSMM301C79FZ.46.26.C04.1.454.light.4.raw

SEQ ID NO: 604307 - DNA, 524 bp, Homo sapiens
  misc_feature: HIJSMM301B8OU3.40.27.C05.1.454.light.4.raw
tctagcgactcacgaccggtgctcgatttagacgcgatcgaagggtttggggggagaagacaggattcaggccaatctccagcatggccggcttccctctcctcctcaccctcctcactcactgtgcagggtcctgggcccagtctgtgctgactcagccaccctcagcgtctgagacccccgggcagcaggttaccgtctcttgttctggaagcagctccaacatcggaagtaattctgtatactggtaccagtgcctcccaggaacggcccccaaacttctcgtctatagggattatcagcggcccttaggggtccctgaccgattctctggctccaggtctggcacctcagcctccctggccatcagtgggctccggcccgaggatgaggcggattattattgtgtgtcatgggatgacagaatgaatggtccggtgttcggcggagggaccaggctgaccgtcctaggtcagcccaaggctgccccctcggtcactctgttcccgccctcctcagtcgct

SEQ ID NO: 604308 - DNA, 485 bp, Homo sapiens; identical to SEQ ID NO: 535822
  misc_feature: HIJSMM301AQMO3.14.53.E09.1.454.light.4.raw

SEQ ID NO: 604309 - DNA, 501 bp, Homo sapiens
  misc_feature: HIJSMM301AQK4U.53.33.C11.1.454.light.4.raw
cgcgtatacacacgaccggtgctcgatttagagtgagctcgttgggtttgggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaagaaaatatgcttattggtaccagcagaggtcaggccaggcccctgtgctggtcatctatgaggacaccaaacgaccctccgggatccctgcgagattctctggcgccagctcagggacagtggccaccctgacagtcagtggggcccaggtggaggatgaagctgattactactgttactcaacagacaggagtggaaatcatagggtattcggcggagggaccaaactgaccgtctaggtcagcccaaggctgccccctcggtctac

SEQ ID NO: 604310 - DNA, 515 bp, Homo sapiens
  misc_feature: HIJSMM301AFL5P.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggccgaacggaccgaacggtaggaagtacgaaacgaactagtggctgcaccatctgtcttctatcttcccgtcccact

SEQ ID NO: 604311 - DNA, 511 bp, Homo sapiens
  misc_feature: HIJSMM301D77ZG.48.88.H11.1.454.light.4.raw
agtatacatacacgaccggtgctcgatttagcgacagcgagaacacacaaagggggtagctcaggaagcagagcctggagcatctccactatggcctggactccactacttctcaccctcctcgctcactgcacaggttcttgggccacttttaaactgactcagccccactccgtgtcggggtctccggggaagacggtaagcatcacctgcacccgcaccagtggcgacattgccagcaactttgtgcagtgggtccagcagcgcccgggccgttcccccgccactgtaatatatgaggacattcaaagaccttctggggtccctcctcgattctctggctccatcgacaggtcctccaactccgcctccctcttcatctctgaactgaagactgaggacgaggctgcttattactgtcagtcctctgatggcagcgcagttgtcttcggcggagggaccacactgaccgttatcggtcagcccaaggctgccccctcggtcactctcg

SEQ ID NO: 604312 - DNA, 493 bp, Homo sapiens; identical to SEQ ID NO: 536246
  misc_feature: HIJSMM301C10ZY.49.66.F11.1.454.light.4.raw

SEQ ID NO: 604313 - DNA, 467 bp, Homo sapiens
  misc_feature: HIJSMM301EFTKN.12.39.D06.1.454.light.4.raw
atacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggaggggaatggggtgagaaagatccagtgtagagattgtgatgacccagactccagtctccttgtctctcacccctggagagcaggcctccatgtcctgcaggtctagtctgtgcctcctgcatagtgacggatgctcccttttgtattggtttctgcagagaggcaggccagtctccacaactcctgatctatgaagttgccacccggctctctggagtgccagatatgttcagtggctgcgggtcaggcacagatctcacactagaaaaacaggccgggtggagagtgaccatgttggaacttatta

SEQ ID NO: 604314 - DNA, 509 bp, Homo sapiens
  misc_feature: HIJSMM301EEYBX.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaacccactcgtcactctgttcccg

SEQ ID NO: 604315 - DNA, 505 bp, Homo sapiens; identical to SEQ ID NO: 535987
  misc_feature: HIJSMM301DR8QH.18.37.D04.1.454.light.4.raw

SEQ ID NO: 604316 - DNA, 510 bp, Homo sapiens; identical to SEQ ID NO: 566324
  misc_feature: HIJSMM301DBR00.5.60.F05.1.454.light.4.raw

SEQ ID NO: 604317 - DNA, 495 bp, Homo sapiens
  misc_feature: HIJSMM301C0CDV.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgtgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcacacgtgggacatgggcactgcgatcttcggcggagggaccaagctgaccgtcctgggtcagcccaaggctgccccctcggtcactc

SEQ ID NO: 604318 - DNA, 447 bp, Homo sapiens; identical to SEQ ID NO: 535201
  misc_feature: HIJSMM301DL75H.18.9.A09.1.454.light.4.raw

SEQ ID NO: 604319 - DNA, 506 bp, Homo sapiens; identical to SEQ ID NO: 580957
  misc_feature: HIJSMM301CWRA7.18.78.H01.1.454.light.4.raw

SEQ ID NO: 604320 - DNA, 481 bp, Homo sapiens
  misc_feature: HIJSMM301BY0A5.11.17.B06.1.454.light.4.raw
cgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagccctgaggtcctgatctatgctgcatccagtttgcagagtggggtcccatcaaggttcagtggcagtggatctgcgacagatttcactctcaccatcagcagtctgcaacctgaagattttgcaacttactactgtcaacagagttacagtaccccgtggacgttcggccgaaggaccaacggtaggaaatacaaacgaactagtggctgcaa

SEQ ID NO: 604321 - DNA, 485 bp, Homo sapiens; identical to SEQ ID NO: 536040
  misc_feature: HIJSMM301CLA4N.15.1.A01.1.454.light.4.raw

SEQ ID NO: 604322 - DNA, 499 bp, Homo sapiens
  misc_feature: HIJSMM301ES238.49.78.H01.1.454.light.4.raw
agtcgagagacacgaccggtgctcgatttagtgtgagtagtttgggtttgggggctgtgggtccaggaggcagaactctgggtgtctcaccatggcctggatccctctacttctccccctcctcactctctgcacaggctctgaggcctcctctgaattgcaacagacatcctcggtgtcagcgtccccaggacagacggccagaattacttgctctggagatgcattggcgaaacaatttgcttcttggttccagcagaagccaggccaagcccctatcttgatgatctataaaggctctgagaggccctcagggatccctgagcgattctctgggtcccactcaggggccacagccgtgttgaccatcactggagtccaggcagaagacgaggctgactattattgtcagtcagccgacaacactatgtctccgtgtttttcggtcggagggaccaggctgaccgtcctggtcagccaaggctgcccctcggcactc

SEQ ID NO: 604323 - DNA, 488 bp, Homo sapiens
  misc_feature: HIJSMM301AYGAY.12.51.E07.1.454.light.4.raw
  modified_base (407)..(407): a, c, t, g, unknown or other
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttnttactgccaacagtataatggttatgaatccacttttggccaagggaccaagctggagatcaaacgaactgtggctgcacc

SEQ ID NO: 604324 - DNA, 487 bp, Homo sapiens; identical to SEQ ID NO: 536206
  misc_feature: HIJSMM301CDMUC.47.38.D05.1.454.light.4.raw

SEQ ID NO: 604325 - DNA, 496 bp, Homo sapiens; identical to SEQ ID NO: 573080
  misc_feature: HIJSMM301CLCT8.22.14.B03.1.454.light.4.raw

SEQ ID NO: 604326 - DNA, 503 bp, Homo sapiens; identical to SEQ ID NO: 559148
  misc_feature: HIJSMM301BR2PU.7.31.C09.1.454.light.4.raw

SEQ ID NO: 604327 - DNA, 485 bp, Homo sapiens; identical to SEQ ID NO: 535985
  misc_feature: HIJSMM301BK3T5.15.1.A01.1.454.light.4.raw

SEQ ID NO: 604328 - DNA, 496 bp, Homo sapiens; identical to SEQ ID NO: 556037
  misc_feature: HIJSMM301EG9EF.41.38.D05.1.454.light.4.raw

SEQ ID NO: 604329 - DNA, 496 bp, Homo sapiens
  misc_feature: HIJSMM301BNA62.10.79.H02.1.454.light.4.raw
catagtagtgcacgaccggtgctcgatttagtgtcacacgaagggaaagggggagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccaggggaccaagctggaggatcaaacgaactgtggctgcaccatctgtcttcta

SEQ ID NO: 604330 - DNA, 508 bp, Homo sapiens; identical to SEQ ID NO: 553020
  misc_feature: HIJSMM301BMH7R.17.41.D08.1.454.light.4.raw

SEQ ID NO: 604331 - DNA, 505 bp, Homo sapiens
  misc_feature: HIJSMM301ER1HK.18.78.H01.1.454.light.4.raw
tacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggcccaacccactgtca

SEQ ID NO: 604332 - DNA, 511 bp, Homo sapiens
  misc_feature: HIJSMM301EFW8C.21.87.H10.1.454.light.4.raw
tcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaactcttaatttctggcgtcaatcagcgaccctcacatgtttccagtcgattctctgcatccaagtctggcaacacggcctttctgacaatctctcaactccaggctgaagacgaggctatttattactgctcctcatacgcaggtggcactatttttcttgggttttttggcggtcgggacccagatgactgtcctcagtcagcccaaggcctgccccctcggt

SEQ ID NO: 604333 - DNA, 471 bp, Homo sapiens
  misc_feature: HIJSMM301DT1PR.52.19.B08.1.454.light.4.raw
cgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttgccgggcgagtcgagacattagcatgtatctgaattggtatcagcaaaaagtagggacagcccctaaactcctgatcctcgatgcatccactttggagacaggggtcccatcaaggttcagtggaagtggctctgggacagattttactttcaccatcagcaggctgcagcctgaagatgttgcaacatattactgtcaacagtataatcgtctcccgctcactttcggcgggggtaccaaggtggagatcaagcgaactgtggctgcacc

SEQ ID NO: 604334 - DNA, 497 bp, Homo sapiens; identical to SEQ ID NO: 535764
  misc_feature: HIJSMM301AWD0R.22.20.B09.1.454.light.4.raw

SEQ ID NO: 604335 - DNA, 512 bp, Homo sapiens; identical to SEQ ID NO: 541300
  misc_feature: HIJSMM301DR0M5.17.33.C11.1.454.light.4.raw

SEQ ID NO: 604336 - DNA, 505 bp, Homo sapiens; identical to SEQ ID NO: 546412
  misc_feature: HIJSMM301BG3Z8.22.21.B10.1.454.light.4.raw

SEQ ID NO: 604337 - DNA, 522 bp, Homo sapiens
  misc_feature: HIJSMM301EZKCB.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttaaggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccgcct

SEQ ID NO: 604338 - DNA, 507 bp, Homo sapiens; identical to SEQ ID NO: 542621
  misc_feature: HIJSMM301EHMAQ.4.10.A10.1.454.light.4.raw

SEQ ID NO: 604339 - DNA, 494 bp, Homo sapiens; identical to SEQ ID NO: 541035
  misc_feature: HIJSMM301A4IRV.26.12.B01.1.454.light.4.raw

SEQ ID NO: 604340 - DNA, 484 bp, Homo sapiens; identical to SEQ ID NO: 551212
  misc_feature: HIJSMM301ELC47.3.10.A10.1.454.light.4.raw

SEQ ID NO: 604341 - DNA, 479 bp, Homo sapiens
  misc_feature: HIJSMM301D7YPN.26.72.G06.1.454.light.4.raw
agactatactcacgaccggtgctcgatttagctacgactgcaagggaaagggtgagatccctcactgtggctcactttcagcggagggaccacggtggagatcacacgtaagtgcactttcctaatgctttttcttataaggttttaagtttggagcgtttttgtgtttgagatgttagctcaggtcaattccaaagagtaccagattctttcaaaaagtcagatgagtaagggatagaaaattagttcaccttaaggaacagccaagcgctagccagttaagtgaggcatctcaattgcaaggttttctctgcatcggtcaggttagtgatattaacagcgaaaaagagatttttgttaaggggaaagtaatgaagttaacactgtggatcaccttcggccaagggacacgactggagattaaacgaactgtggctgcaccatctgtcttcatcttcccgccatctgaagtatagtct

SEQ ID NO: 604342 - DNA, 521 bp, Homo sapiens; identical to SEQ ID NO: 538715
  misc_feature: HIJSMM301A4XLQ.27.23.C01.1.454.light.4.raw

SEQ ID NO: 604343 - DNA, 514 bp, Homo sapiens; identical to SEQ ID NO: 541418
  misc_feature: HIJSMM301CLA82.17.33.C11.1.454.light.4.raw

SEQ ID NO: 604344 - DNA, 506 bp, Homo sapiens; identical to SEQ ID NO: 547367
  misc_feature: HIJSMM301AZQLL.16.46.E02.1.454.light.4.raw

SEQ ID NO: 604345 - DNA, 444 bp, Homo sapiens
  misc_feature: HIJSMM301CN5CA.11.3.A03.1.454.light.4.raw
  modified_base (407)..(407): a, c, t, g, unknown or other
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaaccgtcctaggtcagcccaaggctgcccccncggttcactctgttcccgcccctcctcgtatctctcg

SEQ ID NO: 604346 - DNA, 510 bp, Homo sapiens
  misc_feature: HIJSMM301BODF8.13.3.A03.1.454.light.4.raw
  modified_base (409)..(409): a, c, t, g, unknown or other
tcacgtactacacgaccggtgctcgatttagagagcgtcacaggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaactcattatttacggggtcaataagcggccctcagggctttctgatcgcttctctggctccaagtctggcaacacggcctccctgacaatctctggactccaggccgaggacgaggctgatttttacngttgttcatatgcaggaaggagtgattatgtctttggaagtgggaccaaggtcaccgtccttggtcagcccaaggccaaccccactgtcactctgttcccg

SEQ ID NO: 604347 - DNA, 497 bp, Homo sapiens; identical to SEQ ID NO: 567512
  misc_feature: HIJSMM301BB527.26.26.C04.1.454.light.4.raw

SEQ ID NO: 604348 - DNA, 503 bp, Homo sapiens; identical to SEQ ID NO: 553919
  misc_feature: HIJSMM301EIBSI.18.59.F04.1.454.light.4.raw

SEQ ID NO: 604349 - DNA, 486 bp, Homo sapiens
  misc_feature: HIJSMM301AXIBY.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggaacgttcggccaaggaccaaggtggatatcagacgaa

SEQ ID NO: 604350 - DNA, 487 bp, Homo sapiens; identical to SEQ ID NO: 538190
  misc_feature: HIJSMM301EFZYT.47.70.G04.1.454.light.4.raw

SEQ ID NO: 604351 - DNA, 488 bp, Homo sapiens
  misc_feature: HIJSMM301AZU6U.43.44.D11.1.454.light.4.raw
  modified_base (454)..(454): a, c, t, g, unknown or other
  modified_base (472)..(472): a, c, t, g, unknown or other
tgtgagtagtcacgaccggtgctcgatttagcgcagtacgaaggggggggtcgagacccacgtcaggacacaacatgcacatgagggtccccgcctcagctcctggggctcctgctgctctggctcccaggtgcccaatgtgacatccaggtgacccagtctccttccaccctgtctgcatctgtcggagacagagtcaccatctcttgccgggccagtcaaagttctgtcaggtggttggcctggtatcagcagaagtcagggcaagcccctaggctcctgatgtttaaggcgtctggttcagagagtgaggccccgtccaggttctctgccagtggatctggaacagaactcacactcatcatccgcagcctgcagcctgatgactttgcaacatattactgccaagagtttgatggtcgtttgtggacgttcggccaagggaccagggtanacgtcaaacgactgtggntgcaccatctgtcttc

SEQ ID NO: 604352 - DNA, 496 bp, Homo sapiens; identical to SEQ ID NO: 538466
  misc_feature: HIJSMM301EGYGY.10.33.C11.1.454.light.4.raw

SEQ ID NO: 604353 - DNA, 499 bp, Homo sapiens
  misc_feature: HIJSMM301DBJBB.3.33.C11.1.454.light.4.raw
agacgcactccacgaccggtgctcgatttagagtgagctcgttgggtttgggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgtccccccg

SEQ ID NO: 604354 - DNA, 513 bp, Homo sapiens
  misc_feature: HIJSMM301C9T5E.40.46.E02.1.454.light.4.raw
tctagcgactcacgaccggtgctcgatttagactcatctacagggaaaggggggcctaaggaagcagcactggtggtgcctcagccatggcctggaccgttctcctcctcggcctcctctctcactgcacagggtctgtgacctcctatgtgctgactcagccactctcggtgtctgtggccccaggacaggcggccaatgttacctgtgggggagacaacattgggagtaaaagtgtgcactggtaccagctgaagccaggccaggcccctgtgttggtcgtctttggacatggtgcccgaccctcggggatccctgagcgattctctgcctccaggtctgggaacacggccaccctgaccatcaccagggtcgaggccggagatgaggccgactattttgtcacgtgtggcacgttagtcatcacgtcttcggaactgggaccacggtcaccgtcctaagtcagcccaaggccaaccccactgtcactctcgttcccgccctcctcagtcg

SEQ ID NO: 604355 - DNA, 497 bp, Homo sapiens; identical to SEQ ID NO: 535286
  misc_feature: HIJSMM301BKSJ2.18.59.F04.1.454.light.4.raw

SEQ ID NO: 604356 - DNA, 496 bp, Homo sapiens; identical to SEQ ID NO: 537225
  misc_feature: HIJSMM301B6UH2.11.59.F04.1.454.light.4.raw

SEQ ID NO: 604357 - DNA, 507 bp, Homo sapiens
  misc_feature: HIJSMM301EJ3JF.17.41.D08.1.454.light.4.raw
cgtagactagcacgaccggtgctcgatttagtcacgcgagaaagggaaaggggagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagtgtttttaaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaatatggtggtacaccccctcactttcggcggagggccgaaggtggagatcaagcgaactgtggctgcaccatctgtcttcatcttcccgcc

SEQ ID NO: 604358 - DNA, 486 bp, Homo sapiens
  misc_feature: HIJSMM301DADWX.19.25.C03.1.454.light.4.raw
tactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcaggtgggtctgggacagagttcactctcaccatcagcagcctgcagtctgaagtattttgctagtttattactgtcagcagtataatactggcctcagtacttcggcggagggaccaaggtggagatacaaacgaactgtggctgcac

SEQ ID NO: 604359 - DNA, 507 bp, Homo sapiens; identical to SEQ ID NO: 565672
  misc_feature: HIJSMM301C1GO5.8.28.C06.1.454.light.4.raw

SEQ ID NO: 604360 - DNA, 505 bp, Homo sapiens
  misc_feature: HIJSMM301CXK3T.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggcccaaccccta

SEQ ID NO: 604361 - DNA, 493 bp, Homo sapiens; identical to SEQ ID NO: 571077
  misc_feature: HIJSMM301A4E4R.16.6.A06.1.454.light.4.raw

SEQ ID NO: 604362 - DNA, 506 bp, Homo sapiens; identical to SEQ ID NO: 540259
  misc_feature: HIJSMM301CBDRQ.15.5.A05.1.454.light.4.raw

SEQ ID NO: 604363 - DNA, 497 bp, Homo sapiens; identical to SEQ ID NO: 551301
  misc_feature: HIJSMM301DWMJ9.15.81.H04.1.454.light.4.raw

SEQ ID NO: 604364 - DNA, 490 bp, Homo sapiens
  misc_feature: HIJSMM301B9FP1.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctcgggctccaactctgggaacacggccactctgaccatcagtagggtcgaagccggggatgaggccgactattactgtcaggtgtgggatagtagtcgtgagcatgtggtattcggcggagggaccaaactgaccgtcctaggtcagcccaaggctgccccctcggt

SEQ ID NO: 604365 - DNA, 487 bp, Homo sapiens; identical to SEQ ID NO: 537009
  misc_feature: HIJSMM301ENF84.12.88.H11.1.454.light.4.raw

SEQ ID NO: 604366 - DNA, 489 bp, Homo sapiens
  misc_feature: HIJSMM301B1BZB.3.72.G06.1.454.light.4.raw
agacgcactccacgaccggtgctcgatttagctacgactgcaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtgagagacagcgtcaccatcacttgccgggcaagtcaaagcattagcacttatttgaattggtttcggcagaaaccggggacagcccctgagctcctgatctataaagcatccaatttgcaaactggggtcccatcaaggttcagtggcagtggatctgggacacatttcactctcaccatcagcaatctgcaacctgaagattttgcaacttactactgtcaacagagttttagtccccagtggacgttcggccaagggaccagggtggaaatcaaacgaactgtggctgcaccatctgtt

SEQ ID NO: 604367 - DNA, 496 bp, Homo sapiens
  misc_feature: HIJSMM301CI46O.52.29.C07.1.454.light.4.raw
cgcagtacgacacgaccggtgctcgatttagagtgctacgaagggaaagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgcttctctggctccacctcagggacaatggtcacattgaccatcagtggagtccaggcagaagacgaggctgactatttctgtcaatcttcagacatcagtggtacttatgtcttcggaactgggaccaaggtcaccgtcctaggtcagcccaaggccaacccacctgtca

SEQ ID NO: 604368 - DNA, 500 bp, Homo sapiens
  misc_feature: HIJSMM301DSWLQ.2.34.D01.1.454.light.4.raw
acgctcgacacacgaccggtgctcgatttagatcgtctgtgttgggtttgggggctttgcctgggctctgctcctcctcaccctcctcactcagggcacagggtcctgggcccagtctgccctgactcagcccccctccgcgtccgggtctcctggacagtcagtcaccatctcctgcactggaatcagcagtgacctgagtccttataactatgtctcctggtaccaacaacacccaggcaaagcccccaaactcattatttatgaagtcactaagcggccctcaggggtccctgatcgcttctctggctccaagtctggcgagacggcctccctgaccgtctctgggctccaggctgaagatgaggctgattattactgcagctcatatgcaggcagcaacaatgtggcattcggcggagggaccaagctgaccgtcctgggtcagcccaaggctgccccctcggtcactctgttcccgccctcctcctgtcgagcgt

SEQ ID NO: 604369 - DNA, 503 bp, Homo sapiens; identical to SEQ ID NO: 547049
  misc_feature: HIJSMM301ATKAI.18.59.F04.1.454.light.4.raw

SEQ ID NO: 604370 - DNA, 506 bp, Homo sapiens
  misc_feature: HIJSMM301A8QDK.8.42.D09.1.454.light.4.raw
ctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagccccaaactcatgattttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctcggtcactctgttcccaccct

SEQ ID NO: 604371 - DNA, 513 bp, Homo sapiens
  misc_feature: HIJSMM301DNXVA.48.14.B03.1.454.light.4.raw
agtatacatacacgaccggtgctcgatttagtgtgagtagttccgcggggtgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccaagggacccgggtggaaataaaacgaactagtggctgcaccatctgtcttcattcc

SEQ ID NO: 604372 - DNA, 489 bp, Homo sapiens; identical to SEQ ID NO: 541604
  misc_feature: HIJSMM301D70I7.22.86.H09.1.454.light.4.raw

SEQ ID NO: 604373 - DNA, 506 bp, Homo sapiens
  misc_feature: HIJSMM301D3DU2.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggactagttttcactctcacaatcagcagtctcgaacctgaagattttgctaacttactactgtcaacagacttacaatataccgaggacgttcggtcaaggaccaaggtggagatcaaacgaactagtggctgcaccatctgtcttcatctcccgccat

SEQ ID NO: 604374 - DNA, 520 bp, Homo sapiens; identical to SEQ ID NO: 562605
  misc_feature: HIJSMM301BCD7Q.27.23.C01.1.454.light.4.raw
  modified_base (517)..(517): a, c, t, g, unknown or other

SEQ ID NO: 604375 - DNA, 485 bp, Homo sapiens
  misc_feature: HIJSMM301BL2KD.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcacccttcggccaagggacacgactggagattaaacgaactgtggctgcaccat

SEQ ID NO: 604376 - DNA, 495 bp, Homo sapiens; identical to SEQ ID NO: 538269
  misc_feature: HIJSMM301BAM1O.9.1.A01.1.454.light.4.raw

SEQ ID NO: 604377 - DNA, 491 bp, Homo sapiens
  misc_feature: HIJSMM301CLD52.41.59.F04.1.454.light.4.raw
tctatactatcacgaccggtgctcgatttagtacacacacttagggattgggggagtcagacccagtcaggacacagcatggacatgagggtccccgctcagctcctggggctcctgctgctctggttcccaggttcccgatgcggcatccagatgacccagtctccatctttcgtgtctgcatctataggagacagagtcaccatcacttgtcgggcgagtcaggatattaggacgtggttagcctggtatcgacagagaccgggaagagcccctgaactcctcgtctatgatgcatccactttacatcgtggggtcccatcacggttcagcggcagtggatctgggacagacttcagtctcaccatcagtaccctgcagcctgacgattttgcaatttattttgtcaacaggctaataggttcctcaacattcggccctgggaccagagtggatttgaagcgaactgtggctgcaccatctgtcttcta

SEQ ID NO: 604378 - DNA, 494 bp, Homo sapiens; identical to SEQ ID NO: 535828
  misc_feature: HIJSMM301D41E5.3.36.D03.1.454.light.4.raw

SEQ ID NO: 604379 - DNA, 489 bp, Homo sapiens
  misc_feature: HIJSMM301CFQ5K.19.57.F02.1.454.light.4.raw
tactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttatttttgtcaacaggctaacactttccccctcacctttcggcggagggaccaaggtggagatcaagcgaactgtggctgcaccat

SEQ ID NO: 604380 - DNA, 505 bp, Homo sapiens; identical to SEQ ID NO: 535503
  misc_feature: HIJSMM301A908P.8.28.C06.1.454.light.4.raw

SEQ ID NO: 604381 - DNA, 504 bp, Homo sapiens; identical to SEQ ID NO: 536385
  misc_feature: HIJSMM301EKYGW.27.78.H01.1.454.light.4.raw

SEQ ID NO: 604382 - DNA, 491 bp, Homo sapiens
  misc_feature: HIJSMM301EJBFB.19.28.C06.1.454.light.4.raw
tactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggttaacagtgatggcagccacaccaagggggacgggatccctgatcgtttttcagggtccagctctggggctgagcgctacctcaccatctccagcctccagtctgaggatgaggctgactattactgtcagacctggggcactggttatggtggttttcggcggagggaccaagctgaccgtcctaggtcagcccaaggctgcccccg

SEQ ID NO: 604383 - DNA, 505 bp, Homo sapiens
  misc_feature: HIJSMM301C22K2.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcgtccgaacggaccgaacggtaggaagtacaaacgaactagtggtctcgcacca

SEQ ID NO: 604384 - DNA, 479 bp, Homo sapiens; identical to SEQ ID NO: 535665
  misc_feature: HIJSMM301BQUJW.12.10.A10.1.454.light.4.raw

SEQ ID NO: 604385 - DNA, 518 bp, Homo sapiens
  misc_feature: HIJSMM301EABJN.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggtacgaggctgactattactgcctactctactttggtgtgctgtgctattcggcggtaggaccaagctgaccgtcttaagtcagcccaaggcctagccccctggtcactctcgttcccgcctcctccg

SEQ ID NO: 604386 - DNA, 477 bp, Homo sapiens; identical to SEQ ID NO: 601030
  misc_feature: HIJSMM301AHA60.26.72.G06.1.454.light.4.raw

SEQ ID NO: 604387 - DNA, 494 bp, Homo sapiens; identical to SEQ ID NO: 534994
  misc_feature: HIJSMM301DVXYC.27.78.H01.1.454.light.4.raw

SEQ ID NO: 604388 - DNA, 484 bp, Homo sapiens; identical to SEQ ID NO: 541039
  misc_feature: HIJSMM301EMPAC.46.35.D02.1.454.light.4.raw

SEQ ID NO: 604389 - DNA, 447 bp, Homo sapiens; identical to SEQ ID NO: 535020
  misc_feature: HIJSMM301D8ZIE.18.9.A09.1.454.light.4.raw

SEQ ID NO: 604390 - DNA, 503 bp, Homo sapiens
  misc_feature: HIJSMM301DKKOV.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctggtcactctgttcccgcctcctcg

SEQ ID NO: 604391 - DNA, 496 bp, Homo sapiens; identical to SEQ ID NO: 535541
  misc_feature: HIJSMM301AZ7U1.3.33.C11.1.454.light.4.raw

SEQ ID NO: 604392 - DNA, 504 bp, Homo sapiens; identical to SEQ ID NO: 538940
  misc_feature: HIJSMM301AMV98.2.35.D02.1.454.light.4.raw

SEQ ID NO: 604393 - DNA, 504 bp, Homo sapiens
  misc_feature: HIJSMM301DQZT8.40.23.C01.1.454.light.4.raw
tctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagtactttgctagtttattactgtcagcagcgtaccaactggccgctctactttcggcggagggaccaaggtggagatacaaacgaactgtggctgcaccatctgtcttcattccc

SEQ ID NO: 604394 - DNA, 505 bp, Homo sapiens; identical to SEQ ID NO: 582289
  misc_feature: HIJSMM301DUT3O.15.66.F11.1.454.light.4.raw

SEQ ID NO: 604395 - DNA, 481 bp, Homo sapiens; identical to SEQ ID NO: 535993
  misc_feature: HIJSMM301A8OC7.21.25.C03.1.454.light.4.raw

SEQ ID NO: 604396 - DNA, 519 bp, Homo sapiens
  misc_feature: HIJSMM301CJ82D.13.53.E09.1.454.light.4.raw
tcacgtactacacgaccggtgctcgatttagagagagtgtgttgggtttgggggagtcagtctcagtcaggacaccccagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgtccacggaccgaacggtaggaaagtacaagacgaacgtacgtggtcgtgcgaccactctcgtcttctactcttcccgt

SEQ ID NO: 604397 - DNA, 504 bp, Homo sapiens
  misc_feature: HIJSMM301D4XEI.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcacttttcgatgtcctattcggcggagggaccaagctgaccgtcctgggtcagcccaaggctcgcccctcggtcactctgttccccctcctctacgtcgtat

SEQ ID NO: 604398 - DNA, 494 bp, Homo sapiens
  misc_feature: HIJSMM301BUYUV.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgcagtttattactgttcagcagtatgatacctggcctccgtacacttttggccgggggaccaagctggaaatcaagcgaactgtggctgcaccatctgtcttcatt

SEQ ID NO: 604399 - DNA, 456 bp, Homo sapiens
  misc_feature: HIJSMM301EW0OU.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccgaaagctgaccgtcctaagtcagcccaaggctgccccctccggtcactctgttccaccctcctccacgagagta

SEQ ID NO: 604400 - DNA, 488 bp, Homo sapiens; identical to SEQ ID NO: 552722
  misc_feature: HIJSMM301DNXPA.17.35.D02.1.454.light.4.raw

SEQ ID NO: 604401 - DNA, 488 bp, Homo sapiens
  misc_feature: HIJSMM301C2WC1.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgtcgtcgacggacgaacgtaggaacgtacaacgaac

SEQ ID NO: 604402 - DNA, 496 bp, Homo sapiens
  misc_feature: HIJSMM301DQ8DP.15.25.C03.1.454.light.4.raw
  modified_base (471)..(471): a, c, t, g, unknown or other
tctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatcagcagagtggaggctgaggacgttggggtttattactgcatgcaaggtctacaaaccccgatcaccttcggccgaggacacgcctggnattaaacgaactgtggctgcaccat

SEQ ID NO: 604403 - DNA, 517 bp, Homo sapiens; identical to SEQ ID NO: 548781
  misc_feature: HIJSMM301DLWVD.19.80.H03.1.454.light.4.raw

SEQ ID NO: 604404 - DNA, 453 bp, Homo sapiens
  misc_feature: HIJSMM301D4FRR.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgccccctcggtcactctgttcccacctcctccacgagagta

SEQ ID NO: 604405 - DNA, 485 bp, Homo sapiens
  misc_feature: HIJSMM301ALNVN.10.53.E09.1.454.light.4.raw
catagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttattcagctccgacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgcggcagtttattactgtcagcactattatagtaccccattcacattcggccctgggaccaagtggagatcaaacgaa

SEQ ID NO: 604406 - DNA, 513 bp, Homo sapiens
  misc_feature: HIJSMM301CQMJW.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtgttttcggcggagggaccaagctgaccgtcctaggtcagcccaaggctgccccctcggtcactctgttccccg

SEQ ID NO: 604407 - DNA, 489 bp, Homo sapiens
  misc_feature: HIJSMM301A1KHB.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttatcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggtccaagggaccaaggtaggagtatcagacgaa

SEQ ID NO: 604408 - DNA, 503 bp, Homo sapiens
  misc_feature: HIJSMM301CPST5.21.22.B11.1.454.light.4.raw
  modified_base (469)..(469): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgacccgattctctggctccaagtctggcacctcagccctccctgaccatcagtgggctccggtccgaggatgaggctgactattactgtgcatcacgggacgcaacatgggatgacaatctgagcggttgggtgttcggnggagggaccaactgaccgtcctaggtcagcccaa

SEQ ID NO: 604409 - DNA, 507 bp, Homo sapiens
  misc_feature: HIJSMM301DY4UM.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgtcgtcgacggacgaacggtaggaaggtacgaaacgaacgtaacgtggtcgtcgtcgaccactactcgtcttt

SEQ ID NO: 604410 - DNA, 471 bp, Homo sapiens
  misc_feature: HIJSMM301B7PP9.52.23.C01.1.454.light.4.raw
  modified_base (433)..(433): a, c, t, g, unknown or other
cgcagtacgacacgaccggtgctcgatttagtacacgtgattagggattggggcagaagtctctctcagccaggacacagcatggacatgagggtccctgctcagctcctgggactcctgctgctctggctcccagataccagatgtgacatccagatgacccagtctccatcctccctgtctgcatctgttggagacagagtcaccatctcttgccgggcgagtcaggtcattaacagttatttagcctggtatcagcaaaaaccagggcaagttcctgaactcctgatctatgacacatccactttgcaatcaggggtcccatctcggttcgttggcagtgggtctgggacagattttactctcaccatcagcagcctgcagcctgaagatgttgcaacttatttctgtcataactatgatgatgcccctnacacgttcggccaagggccaagctggaaatcaaacgaa

SEQ ID NO: 604411 - DNA, 487 bp, Homo sapiens; identical to SEQ ID NO: 536206
  misc_feature: HIJSMM301ENRQZ.47.38.D05.1.454.light.4.raw

SEQ ID NO: 604412 - DNA, 505 bp, Homo sapiens; identical to SEQ ID NO: 535503
  misc_feature: HIJSMM301DZ2KM.8.28.C06.1.454.light.4.raw

SEQ ID NO: 604413 - DNA, 494 bp, Homo sapiens; identical to SEQ ID NO: 534994
  misc_feature: HIJSMM301B8JMM.27.78.H01.1.454.light.4.raw

SEQ ID NO: 604414 - DNA, 490 bp, Homo sapiens
  misc_feature: HIJSMM301C31VR.40.83.H06.1.454.light.4.raw
tctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatgggtgttcggcggagggaccaaacgtgtccgtcctaggtcacgaccccg

SEQ ID NO: 604415 - DNA, 499 bp, Homo sapiens; identical to SEQ ID NO: 551769
  misc_feature: HIJSMM301E0VZS.43.34.D01.1.454.light.4.raw

SEQ ID NO: 604416 - DNA, 479 bp, Homo sapiens
  misc_feature: HIJSMM301B4TSJ.16.86.H09.1.454.light.4.raw
tgtactactccacgaccggtgctcgatttagtgctatagacttgggtttggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgccccctcggtcactctgttccccaccctcctcgagtagtaca

SEQ ID NO: 604417 - DNA, 492 bp, Homo sapiens; identical to SEQ ID NO: 536010
  misc_feature: HIJSMM301CTQ7F.10.20.B09.1.454.light.4.raw

SEQ ID NO: 604418 - DNA, 489 bp, Homo sapiens
  misc_feature: HIJSMM301BTF55.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcaggcacaaacctggccaggctcccaggctcctcatcctatgctgcatccatcagggccactggcatcccaggcagattcagtggcagtgggtctgggacagacttcactctcaccatcagcagactggagcctgaagattttgcagtctattactgtcagcagtatggtcacgtcccaagtaacttttggccaggggaccaagctggagatcaaacgaactgtggctgcaccat

SEQ ID NO: 604419 - DNA, 495 bp, Homo sapiens; identical to SEQ ID NO: 537716
  misc_feature: HIJSMM301C7CFN.22.14.B03.1.454.light.4.raw

SEQ ID NO: 604420 - DNA, 513 bp, Homo sapiens
  misc_feature: HIJSMM301AVU53.8.34.D01.1.454.light.4.raw
ctcgcgtgtccacgaccggtgctcgatttagatcgtctgtgttgggtttgggggaggaactgctcagttaggacccagagggaaccatggaagccccagctcggcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccactttcggccctcgggaccaaggtggatatacaaacgaactagtggctgcaccatctgtcttcactt

SEQ ID NO: 604421 - DNA, 444 bp, Homo sapiens; identical to SEQ ID NO: 535192
  misc_feature: HIJSMM301DMKD1.5.9.A09.1.454.light.4.raw

SEQ ID NO: 604422 - DNA, 455 bp, Homo sapiens
  misc_feature: HIJSMM301BFP6E.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgcccctccggtcactctgttcccgccctccctccacgagagta

SEQ ID NO: 604423 - DNA, 495 bp, Homo sapiens
  misc_feature: HIJSMM301DDJU1.52.82.H05.1.454.light.4.raw
cgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggacactgagaggccctcagggatccctgagcgattctctggctccacctcagggacactagtcacgttgaccatcagtggagtccaggcagaggacgaggctgactaccactgtcaatcaacagacagcagtggttcttatgtcttcgcaactgggaccaaggtcaccgtcctaggtcagcccaaggcccaaccccactgtcactcc

SEQ ID NO: 604424 - DNA, 499 bp, Homo sapiens
  misc_feature: HIJSMM301DVKG3.16.78.H01.1.454.light.4.raw
  modified_base (469)..(469): a, c, t, g, unknown or other
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggcccactggtatcccagccaggttcagtggcagtgggtctggggacagagttcactctcaccatcagcagcctgcagtctgaagattttgcggtttattactgtcagcagtataataactggcctccacggtacacttttggccaggggaccaagctgganatcaaacgaactgtggctgcaccatctgtt

SEQ ID NO: 604425 - DNA, 533 bp, Homo sapiens
  misc_feature: HIJSMM301AHWK8.11.58.F03.1.454.light.4.raw
cgagagataccacgaccggtgctcgatttagtctgatcgagaagggaaaggggggaaggcctgagaacacttagccttcatgagtgtccccacccatggcctggatgatgcttctcctcggactccttgcttatgggtcaggagtggattctcaggctttggtgacccaggagccatcgttctcagtgtcccctggagggacactcacactcacttgtggcttgagatacgggtcagtctctgttaattactaccccacgttggtaccgacagaccccaggccagcctccacgcacgctcatttataacacaaagactcgctcttctggggtccctaatcgcttctctggctccatccttgggaacaaagctgccctcaccatcacgggggcccaggcggacgatgaatctatttattattgtgtactttttgtgggtcgtggcatttctgctgtgttcggcggaggcacccaggtgaccgtcctcggtccagcccaaggctgcccccatcggtcactctcgttcccacccct

SEQ ID NO: 604426 - DNA, 485 bp, Homo sapiens
  misc_feature: HIJSMM301CKTZ7.40.83.H06.1.454.light.4.raw
tctagcgactcacgaccggtgctcgatttagatcacgtgcgtcgcgggtctccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatgggtgttcggcggagggaccaaactgtccgtcctaggtcacgg

SEQ ID NO: 604427 - DNA, 510 bp, Homo sapiens; identical to SEQ ID NO: 574761
  misc_feature: HIJSMM301B7CJ5.8.34.D01.1.454.light.4.raw

SEQ ID NO: 604428 - DNA, 501 bp, Homo sapiens
  misc_feature: HIJSMM301C2KR3.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaaccaacctgcaggctgaagatgtggcagtttattactgtcagcaatactatagtcctcctctcacgttcggcggagggaccaaggtggagatcaaacgaactgtggctgcacatctgtctt

SEQ ID NO: 604429 - DNA, 492 bp, Homo sapiens
  misc_feature: HIJSMM301DS4FC.51.76.G10.1.454.light.4.raw
cgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggcctcctcatctatgatgcatccacaagggccactgatactcccagccaggttcaggtggcaggtgggtctgggacaggagttcactctcaccatcagcagcctgcagtctgaagtattttgctaatttattactgtcagcagtataataactggcctccgtactacttttcggccgagggaccaagctggagatacaaacgaactgtggctgcaccta

SEQ ID NO: 604430 - DNA, 505 bp, Homo sapiens
  misc_feature: HIJSMM301CS1A1.8.33.C11.1.454.light.4.raw
ctcgcgtgtccacgaccggtgctcgatttagagtgagctcgttgggtttggggggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccggggccactttcggccctgggaccaaggtggagatcaacgaactgtggctgcaccatctgtcttcatt

SEQ ID NO: 604431 - DNA, 487 bp, Homo sapiens
  misc_feature: HIJSMM301C4IQ9.13.4.A04.1.454.light.4.raw
  modified_base (431)..(431): a, c, t, g, unknown or other
tcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacagggtccatcaaggttcagtgaagtggatctgggacagattttactttcaccatcagcagcctgcagcctgaagatattgcaacatattactgtcaagcagtatgataagtctacccgatacncccttacggcccaagggacaaccgacttaggagaattaaacgaaacttgtagggct

SEQ ID NO: 604432 - DNA, 507 bp, Homo sapiens; identical to SEQ ID NO: 577580
  misc_feature: HIJSMM301B1UEG.15.86.H09.1.454.light.4.raw

SEQ ID NO: 604433 - DNA, 500 bp, Homo sapiens
  misc_feature: HIJSMM301ARMVQ.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctagatcagcccaaggccaacccactgt

SEQ ID NO: 604434 - DNA, 503 bp, Homo sapiens
  misc_feature: HIJSMM301C80BY.10.71.G05.1.454.light.4.raw
catagtagtgcacgaccggtgctcgatttagtgtcgtcgcaagagagagggggagagccctggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaaatagaggtcaaacgaactgtggctgcaccat

SEQ ID NO: 604435 - DNA, 508 bp, Homo sapiens; identical to SEQ ID NO: 556056
  misc_feature: HIJSMM301A80MC.47.85.H08.1.454.light.4.raw

SEQ ID NO: 604436 - DNA, 500 bp, Homo sapiens
  misc_feature: HIJSMM301CA88C.40.42.D09.1.454.light.4.raw
tctagcgactcacgaccggtgctcgatttagacacatacgcagggaaagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagaagcattgccaaaaaatatgcttattggtaccaacagaagtcaggccaggcccctgtgctggtcatctatgaggacaacaaacgaccctccgagatccctgagagattctctggctccagctcagggacaatggccaccttggctctcagtgggcccaggtggaggatgaagctgactactactgttactcagtggacagcagtggaaatcatggggtattcggcggagggaccaagctgaccgtcctaggtcagcccaaggctgccccctcggtcactctcg

SEQ ID NO: 604437 - DNA, 509 bp, Homo sapiens
  misc_feature: HIJSMM301D0EQ5.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtgtgctgtgctattcggcggagggaccaagctgaccgtcttaagtcagcccaaggctcgccccctcggtcactctcgttcccg

SEQ ID NO: 604438 - DNA, 487 bp, Homo sapiens
  misc_feature: HIJSMM301C3VXC.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagtattttgctagtttattactgtcagcagtatcatgactggccgctcaccttcggccaagggacacgactggagaattaaacgaactgtggctgcaccat

SEQ ID NO: 604439 - DNA, 511 bp, Homo sapiens
  misc_feature: HIJSMM301AQIAW.11.1.A01.1.454.light.4.raw
cgagagataccacgaccggtgctcgatttagacgtctcatcaggggaggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggccaacccccactgtcactc

SEQ ID NO: 604440 - DNA, 503 bp, Homo sapiens
  misc_feature: HIJSMM301C0MDH.48.36.D03.1.454.light.4.raw
agtatacatacacgaccggtgctcgatttagctgcgtcacgatctctcttgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccgatcgcctgcactggaaccagcagtgatattggtgcttacaactttgtctcctggtaccaacatcacccaggcaaagtccccaaggtcattatttatgatgtcactaagcggccctcggggtccctgatcgcttctctggctccaagtctggcaacacggcctccctgaccatctctgggctccaggctgaagatcaggctgattattactgctgttcattttcaagtttcctttttgtcttcggaactgggaccgaggtcaccgtcctaggtcagcccaaggccaacccactcgtct

SEQ ID NO: 604441 - DNA, 525 bp, Homo sapiens
  misc_feature: HIJSMM301EQNBF.17.75.G09.1.454.light.4.raw
cgtagactagcacgaccggtgctcgatttagtatagacatcaggggtctggcaccaggggtcccttccaatatcagcaccatggcctggactcctctctttctgttcctcctcacttgctgcccagggtccaattcccaggctgtggtgactcaggaaccctcactgagtgtgtccccaggggggacagtcattctcacctgtgcctccagcactggagaagtgaccagcggccactatccctactggttccaggtgaagtctggccaggcccccaggacactaatttatgatgcgaccaacagacactcctgggcgcctggccgtttttcgggctccctcctcgggggcaaagctgccctgaccctaacggggcgcagcctgaggacgaggccgactattattgcctactatcatttgatggtggtcgtctgcccattttcggcggcgggaccagggtggccgtcctgggtcagcccaaggctgccccctcggtcactctgttcccacctcctcctagtctacg

SEQ ID NO: 604442 - DNA, 519 bp, Homo sapiens
  misc_feature: HIJSMM301A40TZ.5.27.C05.1.454.light.4.raw
atcagacacgcacgaccggtgctcgatttagacgcgatcgaagggtttgggggtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggtcgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccaccctcctccgt

SEQ ID NO: 604443 - DNA, 485 bp, Homo sapiens; identical to SEQ ID NO: 535880
  misc_feature: HIJSMM301BNVV7.7.75.G09.1.454.light.4.raw

SEQ ID NO: 604444 - DNA, 447 bp, Homo sapiens; identical to SEQ ID NO: 535020
  misc_feature: HIJSMM301ETJJ1.18.9.A09.1.454.light.4.raw

SEQ ID NO: 604445 - DNA, 488 bp, Homo sapiens
  misc_feature: HIJSMM301BQGB2.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatccaccagggcccaccggtatcccagccaggttcagtggcagtgggtctgggacagagttcactctcaccatcagcagcctgcagtctgaggattttgctagtttattactgtcagcattacaataactggcctcggctcactttcggcggagggaccaaggtggagatcaaacgaactgtggctgcaccat

SEQ ID NO: 604446 - DNA, 495 bp, Homo sapiens; identical to SEQ ID NO: 595039
  misc_feature: HIJSMM301DK323.22.14.B03.1.454.light.4.raw

SEQ ID NO: 604447 - DNA, 497 bp, Homo sapiens
  misc_feature: HIJSMM301DW5Q2.22.57.F02.1.454.light.4.raw
acatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaacagcctgcagcctgatgatttggcaacttactactgccaaccgtatagtacttattcggtcaccttcggccaagggacacgactggagattaaacgaactgtggctgcaccatctgtcttcattcc

SEQ ID NO: 604448 - DNA, 499 bp, Homo sapiens
  misc_feature: HIJSMM301AGTYQ.41.11.A11.1.454.light.4.raw
tctatactatcacgaccggtgctcgatttagctacgactgcaagggggaggaactgctcagttaggacccagacggaaccatggaagccccagcgcagcttctcttcctcctgctactctggctcccagataccactggagaaatagtggtgacgcagtctccagccaccctgtctgtgtctccaggggaaggagccaccctctcctgcagggccagtcagagtattagcagcagcttagcctggtaccagcagaagcctggccaggctcccaggctcctcgtctatggtgcatccaccagggccactggtatcccagccaggttcagtggcagtgggtctgggacagagttcactctcaccatcaccagcctgcagtctgaagattttggagttttatttctgtcaccagtataaggactggccttgggacgttttggtccacggggaccgaagacgtggagatcagacgaactgtggcgtgcaccatctgtcttcta

SEQ ID NO: 604449 - DNA, 521 bp, Homo sapiens
  misc_feature: HIJSMM301BQZIK.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcggtcgaacggaccgaacggtaggaaggtacgaaacgaactaagtggcgtgcaccactactcgtcttctactcttcccgtcctact

SEQ ID NO: 604450 - DNA, 493 bp, Homo sapiens
  misc_feature: HIJSMM301C4B9K.13.39.D06.1.454.light.4.raw
tcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaaggtggagatcaaacgaaa

SEQ ID NO: 604451 - DNA, 503 bp, Homo sapiens
  misc_feature: HIJSMM301CTB00.48.36.D03.1.454.light.4.raw
agtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttcaagttctttttgtcttcggaactgggaccgaggtcaccgtcctaggtcagcccaaggccaaccccactgtcta

SEQ ID NO: 604452 - DNA, 482 bp, Homo sapiens
  misc_feature: HIJSMM301BB1FS.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgcaacttattactgtctacaagatcacaattatcctgggacgttcggccaagggaccgaaggtggaaatacaaacgaactagtgg

SEQ ID NO: 604453 - DNA, 519 bp, Homo sapiens; identical to SEQ ID NO: 547713
  misc_feature: HIJSMM301ESP7I.5.27.C05.1.454.light.4.raw

SEQ ID NO: 604454 - DNA, 494 bp, Homo sapiens; identical to SEQ ID NO: 534994
  misc_feature: HIJSMM301D1FU8.27.78.H01.1.454.light.4.raw

SEQ ID NO: 604455 - DNA, 478 bp, Homo sapiens; identical to SEQ ID NO: 535129
  misc_feature: HIJSMM301DBA4J.11.11.A11.1.454.light.4.raw

SEQ ID NO: 604456 - DNA, 499 bp, Homo sapiens; identical to SEQ ID NO: 545732
  misc_feature: HIJSMM301CUQSM.3.33.C11.1.454.light.4.raw

SEQ ID NO: 604457 - DNA, 473 bp, Homo sapiens
  misc_feature: HIJSMM301AJFTM.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaattcaccatcagcagcctccaacgtgatgatgttgcaacatactattgtcagcaatatgattttgctcctccgagtgccacgttttggcggggggaccaaggtggacatacaaacgaa

SEQ ID NO: 604458 - DNA, 496 bp, Homo sapiens; identical to SEQ ID NO: 535541
  misc_feature: HIJSMM301DI27V.3.33.C11.1.454.light.4.raw

SEQ ID NO: 604459 - DNA, 506 bp, Homo sapiens
  misc_feature: HIJSMM301D2V4Z.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtccacttccg

SEQ ID NO: 604460 - DNA, 508 bp, Homo sapiens; identical to SEQ ID NO: 550253
  misc_feature: HIJSMM301BY58T.9.55.E11.1.454.light.4.raw

SEQ ID NO: 604461 - DNA, 498 bp, Homo sapiens
  misc_feature: HIJSMM301BB683.40.11.A11.1.454.light.4.raw
tctagcgactcacgaccggtgctcgatttagctacgactgcagggaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtcttttatacaactccaacaagcagcactacttagcttggtaccagcagaaaccaggacagcctcctaaactgctcatttactgggcctctacccgggaatccggggtccctgaccgattcagtggcagcgggtctgggacagatttcactctgaccatcagcagcctgcaggctgaagatgtggcagtttattactgtcaacaatattatattattccgaggacgttcggccaagggaccaaggtggaaatacaaacgaactagtggctgcaccatctgtcttcatcttcccgccat

SEQ ID NO: 604462 - DNA, 521 bp, Homo sapiens; identical to SEQ ID NO: 539470
  misc_feature: HIJSMM301BJ8RO.27.23.C01.1.454.light.4.raw

SEQ ID NO: 604463 - DNA, 521 bp, Homo sapiens; identical to SEQ ID NO: 538715
  misc_feature: HIJSMM301DUYO0.27.23.C01.1.454.light.4.raw

SEQ ID NO: 604464 - DNA, 501 bp, Homo sapiens; identical to SEQ ID NO: 536867
  misc_feature: HIJSMM301A143A.5.86.H09.1.454.light.4.raw

SEQ ID NO: 604465 - DNA, 466 bp, Homo sapiens
  misc_feature: HIJSMM301DL0J3.13.4.A04.1.454.light.4.raw
tcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagattttactttcaccatcagcagcctgcagcctgaagatattgcaacatattactgtcagcagtatgataatctcccgatcaccttaggccaagggacacgactggagattaaacgaa

SEQ ID NO: 604466 - DNA, 501 bp, Homo sapiens; identical to SEQ ID NO: 549899
  misc_feature: HIJSMM301A2769.41.18.B07.1.454.light.4.raw

SEQ ID NO: 604467 - DNA, 497 bp, Homo sapiens
  misc_feature: HIJSMM301BLYDC.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggtcggagggaccgaaggacggaggatcagacgaaactcgtggcgtgcgaccatctgtcttcta

SEQ ID NO: 604468 - DNA, 494 bp, Homo sapiens; identical to SEQ ID NO: 534992
  misc_feature: HIJSMM301DM61U.9.1.A01.1.454.light.4.raw

SEQ ID NO: 604469 - DNA, 476 bp, Homo sapiens
  misc_feature: HIJSMM301EGJ4E.7.67.G01.1.454.light.4.raw
cgtgtctctacacgaccggtgctcgatttagagtatacatattgggtttgggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctcccacagcggggcaggttctgatgttcactggtaccagcagcttccagggacagcccccaaactcctcatatacgagaacaccaatcggccctcaggagtccctgaccgattctctggctccaagtctggcacctcagcctccctggccatcactgggctccaggctgaggatgaggctgattatactgccagtcgtatgacagcagcctgagtgtttgggtgttcggcggaggga

SEQ ID NO: 604470 - DNA, 472 bp, Homo sapiens
  misc_feature: HIJSMM301BGEQ0.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttcactaccccaatcacttcgcctggactgaagtgcatatgaagagaaactgtggctgca

SEQ ID NO: 604471 - DNA, 488 bp, Homo sapiens
  misc_feature: HIJSMM301EH903.43.48.E04.1.454.light.4.raw
tgtgagtagtcacgaccggtgctcgatttagagagcgtcacagagagaaggggcgcacagagagaagggggagaagtagagggatccagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcggggggaccaaggctgaccgtcct

SEQ ID NO: 604472 - DNA, 497 bp, Homo sapiens; identical to SEQ ID NO: 536371
  misc_feature: HIJSMM301CBTSK.16.78.H01.1.454.light.4.raw

SEQ ID NO: 604473 - DNA, 501 bp, Homo sapiens; identical to SEQ ID NO: 536142
  misc_feature: HIJSMM301DNMO1.15.1.A01.1.454.light.4.raw

SEQ ID NO: 604474 - DNA, 489 bp, Homo sapiens
  misc_feature: HIJSMM301DNIFR.12.88.H11.1.454.light.4.raw
atacgacgtacacgaccggtgctcgatttagcgacagcgagaacacacaaaggggtagatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtgggggctgaggatgttggcatttattactgcatgcaggctatacaccttcctgccacttttggccaggggaccaagctggagatcaggcgtaac

SEQ ID NO: 604475 - DNA, 482 bp, Homo sapiens; identical to SEQ ID NO: 541033
  misc_feature: HIJSMM301CXSNS.4.27.C05.1.454.light.4.raw

SEQ ID NO: 604476 - DNA, 483 bp, Homo sapiens
  misc_feature: HIJSMM301EAQ1F.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttatactgtcagacctatagtggtggcccgctcattttcggcggagggaccaaggtgcagatcaaacgaactgtggctgca

SEQ ID NO: 604477 - DNA, 499 bp, Homo sapiens; identical to SEQ ID NO: 564687
  misc_feature: HIJSMM301B8FDB.43.34.D01.1.454.light.4.raw

SEQ ID NO: 604478 - DNA, 488 bp, Homo sapiens; identical to SEQ ID NO: 538017
  misc_feature: HIJSMM301EQ4H4.4.59.F04.1.454.light.4.raw

SEQ ID NO: 604479 - DNA, 502 bp, Homo sapiens; identical to SEQ ID NO: 541971
  misc_feature: HIJSMM301DMQC6.4.39.D06.1.454.light.4.raw

SEQ ID NO: 604480 - DNA, 476 bp, Homo sapiens; identical to SEQ ID NO: 538611
  misc_feature: HIJSMM301CXYI9.7.81.H04.1.454.light.4.raw

SEQ ID NO: 604481 - DNA, 502 bp, Homo sapiens; identical to SEQ ID NO: 564875
  misc_feature: HIJSMM301C1OR1.48.36.D03.1.454.light.4.raw

SEQ ID NO: 604482 - DNA, 521 bp, Homo sapiens; identical to SEQ ID NO: 536990
  misc_feature: HIJSMM301C2FXD.27.23.C01.1.454.light.4.raw
  modified_base (517)..(517): a, c, t, g, unknown or other

SEQ ID NO: 604483 - DNA, 515 bp, Homo sapiens
  misc_feature: HIJSMM301DKN3K.10.28.C06.1.454.light.4.raw
catagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctcaggggtttctgatcgcttctttgcctccaagtctggcaacacggcctccctgaccatctctgggctccagactgaggacgaggctgattattactgcagctcacatacaagcggcagcggttgggtgttcggcgggggaccgacactgaccgtcctaggtcacgcccaaggctgccccctcggtccactctgtt

SEQ ID NO: 604484 - DNA, 493 bp, Homo sapiens
  misc_feature: HIJSMM301BC8D3.52.54.E10.1.454.light.4.raw
  modified_base (470)..(470): a, c, t, g, unknown or other
cgcagtacgacacgaccggtgctcgatttagatcgtagcagaacacacaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtccngggtcagcccaaggccaacccca

SEQ ID NO: 604485 - DNA, 500 bp, Homo sapiens
  misc_feature: HIJSMM301AGHHD.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagattacaattaccctcggacgttcggtccacggggaccgaacggtaggaaagtacaaacgaaactagtggcgtgcgacctaa

SEQ ID NO: 604486 - DNA, 499 bp, Homo sapiens
  misc_feature: HIJSMM301DUOJY.12.86.H09.1.454.light.4.raw
atacgacgtacacgaccggtgctcgatttagtgctatagacttgggtttggggaggaactgctcagttaggacccaggagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgaagattttgcagtttattactgtcagcagcgtagcaactggcctcggttcacttttggccaggggaccaagctggagatcaaacgaactgtggctgcacatctgtcttcatt

SEQ ID NO: 604487 - DNA, 481 bp, Homo sapiens
  misc_feature: HIJSMM301CMGDD.10.73.G07.1.454.light.4.raw
catagtagtgcacgaccggtgctcgatttagctctacgctcagggggagtcagtctcagtcaggacacagcatggacatgagggtccccgctcagctcctggggctcctgctactctggctccgaggtgccagatgtgacatccaaatgacccagtctccatcctccctgtctgcatctttaggcgacagagtcaccattacttgccgggcaagtcagagcattaccaactctttaaattggtttcaacagaggccagggaaagcccctaagctcctggtctatggtgcatccactgtgcaaactggggtcccatccaggttcagtggcagtggatttgggacagatttcactctcaccatcaacaatctgcagcctgatgatttcgcaacttactactgtcaacagagttacacgacgccaatcactttcggccctggaccaaagtggatatcaagcgaactgtggctgcaccatctgtt

SEQ ID NO: 604488 - DNA, 504 bp, Homo sapiens; identical to SEQ ID NO: 543173
  misc_feature: HIJSMM301B7LM1.41.35.D02.1.454.light.4.raw

SEQ ID NO: 604489 - DNA, 479 bp, Homo sapiens
  misc_feature: HIJSMM301CGLD7.51.75.G09.1.454.light.4.raw
cgatcgtatacacgaccggtgctcgatttagtatagacatcaggggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggtaatgatgtacactggtaccagcagcttccaggaacagtcccccaaactccctcatttatgctaacaccaatcggccctcaggggtccctgcccgattctctggctccaggtctggcacctcagcctccctggccatcactgggctcgggctgaggatgaggctgattattactgccagtcccatgacagcagcctgagtgtgctgttcggcggagggaccaagctgaccgtcc

SEQ ID NO: 604490 - DNA, 494 bp, Homo sapiens; identical to SEQ ID NO: 534994
  misc_feature: HIJSMM301DV090.27.78.H01.1.454.light.4.raw

SEQ ID NO: 604491 - DNA, 501 bp, Homo sapiens; identical to SEQ ID NO: 535746
  misc_feature: HIJSMM301APFRL.18.11.A11.1.454.light.4.raw

SEQ ID NO: 604492 - DNA, 496 bp, Homo sapiens; identical to SEQ ID NO: 572828
  misc_feature: HIJSMM301BYO6T.47.64.F09.1.454.light.4.raw

SEQ ID NO: 604493 - DNA, 489 bp, Homo sapiens; identical to SEQ ID NO: 535139
  misc_feature: HIJSMM301BE4CG.14.55.E11.1.454.light.4.raw

SEQ ID NO: 604494 - DNA, 494 bp, Homo sapiens
  misc_feature: HIJSMM301BZBBA.5.12.B01.1.454.light.4.raw
atcagacacgcacgaccggtgctcgatttagtagtgtagattccgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaacagtgacattggtgcttatgactatgtctcgtggtatcaaaagtatccagacacagcccccaaactcatcctttatgatgtccgtgttcggccctcaggggtttctgttcgcttctctggctccaagtctggcagcacggcctccctgaccatctctgggctccaggctgaggacgaggctgactattattgcagttcatatggtagtatgaagactcttgtgattttcggcggagggaccaagctgaccgtcctgagtcagcccaaggctcg

SEQ ID NO: 604495 - DNA, 519 bp, Homo sapiens
  misc_feature: HIJSMM301ARLRN.43.23.C01.1.454.light.4.raw
tgtgagtagtcacgaccggtgctcgatttagtacacgtgattagggattggggtctggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttgggggcaaagctgccctgacactgtcaggtgtgcaccctgaggacgaggctgagtattactgtctgctccactttcgtactgcctgggtcttcggcgggggactcagttgaccgtcctaggtcagcccaaggctgccccctcggtcactctgttcccaccctcctcta

SEQ ID NO: 604496 - DNA, 506 bp, Homo sapiens; identical to SEQ ID NO: 534969
  misc_feature: HIJSMM301DDO8Z.18.37.D04.1.454.light.4.raw

SEQ ID NO: 604497 - DNA, 503 bp, Homo sapiens; identical to SEQ ID NO: 536760
  misc_feature: HIJSMM301EDXCF.47.55.E11.1.454.light.4.raw

SEQ ID NO: 604498 - DNA, 484 bp, Homo sapiens; identical to SEQ ID NO: 535400
  misc_feature: HIJSMM301AFTNH.46.26.C04.1.454.light.4.raw

SEQ ID NO: 604499 - DNA, 532 bp, Homo sapiens
  misc_feature: HIJSMM301EQXG0.48.57.F02.1.454.light.4.raw
agtatacatacacgaccggtgctcgatttagctcgatatagttgggtttggggtcagcttcagctgtggtagagaagacaggattcaggacaatctccagcatggccggcttccctctcctcctcaccctcctcactcactgtgcagggtcctgggcccagtctgtgttgactcagccaccctcaacgtctgggactcccgggcagaccgtcaccatctcttgttctggcagcagatggaacatcgggagctaattttgttcactggtaccagcaactgccaggagccggcccccaaactcctcatctacaggaatgataagcgaccctcgaggggtccctgcccgattctctggctccaagtctggcaccacagccctccctggccatcagaggacctccgggtccgaggatggagggtgtatttttattgtgcttgtttgggatgacgacatgaattggttcgtagttttcgggcgggagggaaccaaacgtgaccgtcctgggtcagcccaaggctcggccccctcggt

SEQ ID NO: 604500 - DNA, 473 bp, Homo sapiens; identical to SEQ ID NO: 536941
  misc_feature: HIJSMM301CBEG4.3.38.D05.1.454.light.4.raw

SEQ ID NO: 604501 - DNA, 488 bp, Homo sapiens; identical to SEQ ID NO: 535081
  misc_feature: HIJSMM301CKLTR.26.23.C01.1.454.light.4.raw

SEQ ID NO: 604502 - DNA, 494 bp, Homo sapiens
  misc_feature: HIJSMM301A8H6X.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccaggggaccaagctggagatcaaaacgaactgtgg

SEQ ID NO: 604503 - DNA, 490 bp, Homo sapiens; identical to SEQ ID NO: 571829
  misc_feature: HIJSMM301AI6ER.12.88.H11.1.454.light.4.raw

SEQ ID NO: 604504 - DNA, 500 bp, Homo sapiens
  misc_feature: HIJSMM301EFEGE.14.57.F02.1.454.light.4.raw
cgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcgggcaattggccgctcactttcggcgggggaccgaaggtggagttcaacgaactgtggctgcaccatctgtcttcatcttcccg

SEQ ID NO: 604505 - DNA, 469 bp, Homo sapiens
  misc_feature: HIJSMM301A1WKV.49.8.A08.1.454.light.4.raw
agtcgagagacacgaccggtgctcgatttagcatactctacagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggacagcccctaagctcctgatcctcgatgcatccactttggaaacaggggtcccatcaaggttcagtggaagtggctctgggacagattttactttcaccatcagcagactgcagcctgaagatattgcaacatattactgtcaacagtatgatagtctcccgctcactttcggcggagggaccaaggtggagatcaaacgaaactgtgg

SEQ ID NO: 604506 - DNA, 520 bp, Homo sapiens; identical to SEQ ID NO: 558856
  misc_feature: HIJSMM301EJBOT.12.71.G05.1.454.light.4.raw

SEQ ID NO: 604507 - DNA, 501 bp, Homo sapiens
  misc_feature: HIJSMM301D2TNL.51.81.H04.1.454.light.4.raw
cgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtctcggtcgagcccaacggaccgaaccccaacctcgtcgta

SEQ ID NO: 604508 - DNA, 492 bp, Homo sapiens
  misc_feature: HIJSMM301CR1D3.51.82.H05.1.454.light.4.raw
cgatcgtatacacgaccggtgctcgatttagtcgagctctctcgcgggggcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggaacagttccaacatcggggcaggttataatgtacactggtaccagcaacttccaggaacagccccaaactcctcatccatgataccagaaatcggccctcgggggtccctgaccgattctctggctccaagtctgacacttcagcctccctggccatcactgggctccagactgaggatgaggctgactattactgccagtcctatgacagcaggctgactgctgtggttttcggcggcgggaccaagctgaccgtcctaggtcacgg

SEQ ID NO: 604509 - DNA, 497 bp, Homo sapiens; identical to SEQ ID NO: 545672
  misc_feature: HIJSMM301C7TCH.2.49.E05.1.454.light.4.raw

SEQ ID NO: 604510 - DNA, 454 bp, Homo sapiens; identical to SEQ ID NO: 534964
  misc_feature: HIJSMM301D7K1G.19.86.H09.1.454.light.4.raw

SEQ ID NO: 604511 - DNA, 489 bp, Homo sapiens; identical to SEQ ID NO: 548452
  misc_feature: HIJSMM301DUGVJ.26.37.D04.1.454.light.4.raw

SEQ ID NO: 604512 - DNA, 485 bp, Homo sapiens; identical to SEQ ID NO: 536040
  misc_feature: HIJSMM301A222U.15.1.A01.1.454.light.4.raw

SEQ ID NO: 604513 - DNA, 504 bp, Homo sapiens
  misc_feature: HIJSMM301DSWMJ.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggcccaacccac

SEQ ID NO: 604514 - DNA, 508 bp, Homo sapiens
  misc_feature: HIJSMM301AK6JB.4.28.C06.1.454.light.4.raw
agcactgtagcacgaccggtgctcgatttagagctcacgtattgggtttggggctgggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgacttgggggagagatatgtttcctggtatctccagaggccaggccactcccctattctagtcatgtatcaaactacgaagcgcccctcaggggtccctgagcgcttttctggctccaagtctggggacacagccactctgactctctccggggcccaggccatcgatgagggagactattactgtcaggcgtgggacagcacaactgcagtcttcggcggagggaccagggtgaccgtcctgggtcagcccaaggctgccccctcggtcactctgttcccaccct

SEQ ID NO: 604515 - DNA, 505 bp, Homo sapiens
  misc_feature: HIJSMM301A14IE.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggaggaccaaggtcgaccgtctaggtcagcccaaggctcgtccccccg

SEQ ID NO: 604516 - DNA, 520 bp, Homo sapiens; identical to SEQ ID NO: 537173
  misc_feature: HIJSMM301D0TA5.27.23.C01.1.454.light.4.raw

SEQ ID NO: 604517 - DNA, 507 bp, Homo sapiens
  misc_feature: HIJSMM301C1NGT.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggcccttgggaccaaagtggatatcaaacgaactagtggctgcaccatctgtctt

SEQ ID NO: 604518 - DNA, 489 bp, Homo sapiens; identical to SEQ ID NO: 535386
  misc_feature: HIJSMM301AWZT9.12.51.E07.1.454.light.4.raw

SEQ ID NO: 604519 - DNA, 488 bp, Homo sapiens; identical to SEQ ID NO: 537260
  misc_feature: HIJSMM301DYJ7P.47.70.G04.1.454.light.4.raw

SEQ ID NO: 604520 - DNA, 498 bp, Homo sapiens; identical to SEQ ID NO: 565046
  misc_feature: HIJSMM301B5NO4.3.10.A10.1.454.light.4.raw

SEQ ID NO: 604521 - DNA, 487 bp, Homo sapiens
  misc_feature: HIJSMM301EX4VE.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaacgggaccaaggtggatatcagacgaa

SEQ ID NO: 604522 - DNA, 498 bp, Homo sapiens
  misc_feature: HIJSMM301ET7PF.22.86.H09.1.454.light.4.raw
acatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggctcgccccctcggtcactctcgttccccaccctcctcacgtcg

SEQ ID NO: 604523 - DNA, 461 bp, Homo sapiens
  misc_feature: HIJSMM301BG4TJ.40.2.A02.1.454.light.4.raw
tctagcgactcacgaccggtgctcgatttagactcatctacagggggagtcagacccactcaggacacagcatggacatgagggtccccgctcagctcctggggctcctgctgctctggctcccaggcgccagatgtgccatccagaatgacccagtctccatcctcactgtctgcatctgtaggagacagagtcaccatcacttgccgggcaagtcagggcattggaaatgatttagcctggtatcagcagaaaccaggaaaagcccctcagctcctgatctatactgcatccactttacaaagtgagtcccatcaaggttcagcggcagtggatctggcacagatttcactctcaccatcagcagcctgcagcctgaagattttgcaacttattactgtctacaagattacaattaccctcggacttttggccagggacctggctggagatcaaacgaa

SEQ ID NO: 604524 - DNA, 498 bp, Homo sapiens
  misc_feature: HIJSMM301CQFIT.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaccca

SEQ ID NO: 604525 - DNA, 484 bp, Homo sapiens; identical to SEQ ID NO: 550098
  misc_feature: HIJSMM301EF7W9.26.78.H01.1.454.light.4.raw

SEQ ID NO: 604526 - DNA, 514 bp, Homo sapiens; identical to SEQ ID NO: 541418
  misc_feature: HIJSMM301BDHA9.17.33.C11.1.454.light.4.raw

SEQ ID NO: 604527 - DNA, 504 bp, Homo sapiens; identical to SEQ ID NO: 569797
  misc_feature: HIJSMM301AM6KZ.8.24.C02.1.454.light.4.raw

SEQ ID NO: 604528 - DNA, 487 bp, Homo sapiens
  misc_feature: HIJSMM301AVN0Y.5.34.D01.1.454.light.4.raw
atcagacacgcacgaccggtgctcgatttagatcgtctgtgttggggtttggggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccctccgaccttcggccaaggacacgacctggagattaaacgtaactagtggctgcacca

SEQ ID NO: 604529 - DNA, 495 bp, Homo sapiens
  misc_feature: HIJSMM301BIPZO.52.28.C06.1.454.light.4.raw
cgcagtacgacacgaccggtgctcgatttagagctcacgtattgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcact

SEQ ID NO: 604530 - DNA, 463 bp, Homo sapiens; identical to SEQ ID NO: 543051
  misc_feature: HIJSMM301DZ57E.26.78.H01.1.454.light.4.raw

SEQ ID NO: 604531 - DNA, 494 bp, Homo sapiens; identical to SEQ ID NO: 579885
  misc_feature: HIJSMM301DEKYG.4.27.C05.1.454.light.4.raw

SEQ ID NO: 604532 - DNA, 486 bp, Homo sapiens; identical to SEQ ID NO: 580914
  misc_feature: HIJSMM301EU6W3.3.10.A10.1.454.light.4.raw

SEQ ID NO: 604533 - DNA, 504 bp, Homo sapiens
  misc_feature: HIJSMM301B33CL.41.57.F02.1.454.light.4.raw
tctatactatcacgaccggtgctcgatttagctcgatatagttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctgatcgcttctctggctccaagtctggcaatacggcctcctgacagtctctcggctccaggcggaggacgaggctgattactactgcttctcatatgcagatactaagtcctgggtgttcggcggagggaccaagctgaccgtcctaggtcagcccaaggctcgccccctcggt

SEQ ID NO: 604534 - DNA, 521 bp, Homo sapiens; identical to SEQ ID NO: 538715
  misc_feature: HIJSMM301AQNYO.27.23.C01.1.454.light.4.raw

SEQ ID NO: 604535 - DNA, 510 bp, Homo sapiens
  misc_feature: HIJSMM301EOGEY.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgccgaacgggaccaaggtaggaaagtacaaacgaaactagtggctgcaccatctgttcttctatcttccccg

SEQ ID NO: 604536 - DNA, 502 bp, Homo sapiens
  misc_feature: HIJSMM301A2ILU.18.22.B11.1.454.light.4.raw
tacgagtatgcacgaccggtgctcgatttagacgacagctcagggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggccatctacccgggagtccggggtccctgaccgattcagaggcagcgggtctgggacagatttcactctcaccatcaccaacctgcaggctgaagatgtggcagttttattactgtcagcaatactatagtcctccttctcacgttcggcggagggaccaaggtggagatcaaacgaactgtggctgcaccatctgtctcatcttcccgcatctgaccta

SEQ ID NO: 604537 - DNA, 514 bp, Homo sapiens; identical to SEQ ID NO: 545978
  misc_feature: HIJSMM301BHHE3.17.33.C11.1.454.light.4.raw

SEQ ID NO: 604538 - DNA, 490 bp, Homo sapiens; identical to SEQ ID NO: 538866
  misc_feature: HIJSMM301AJDLD.40.81.H04.1.454.light.4.raw

SEQ ID NO: 604539 - DNA, 508 bp, Homo sapiens
  misc_feature: HIJSMM301BHHZW.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggctccctgaccgtctctggcctccagactgaggacgaggctgattattactgccactcatatagaagtagtactactcctgtggttttcggcggagggaccaagctgaccgtcctaggtcagcccaaggctgccccctcggtcactctgtt

SEQ ID NO: 604540 - DNA, 516 bp, Homo sapiens; identical to SEQ ID NO: 552129
  misc_feature: HIJSMM301AOFJA.27.23.C01.1.454.light.4.raw

SEQ ID NO: 604541 - DNA, 512 bp, Homo sapiens
  misc_feature: HIJSMM301D230L.10.75.G09.1.454.light.4.raw
catagtagtgcacgaccggtgctcgatttagtatagacatcaggggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaagtgacattggttctttaaattttgtctcttggtaccaacagagcccagacaaagcccccaaaattatcatttctgctgtcgagtaatcggccctcaggggtttctagtcgcttctctggctccaagtctggcaacacggcctccctgaccatctctgggctccaggctgaggacgaggctgattattattgcagctcatatacaaacaccaaagctttgatattcggcggagggaccaaactgaccgtccttcgtcagcccaagctgccccctcggtcactctcgttcccta

SEQ ID NO: 604542 - DNA, 519 bp, Homo sapiens; identical to SEQ ID NO: 541911
  misc_feature: HIJSMM301CZKF0.27.23.C01.1.454.light.4.raw

SEQ ID NO: 604543 - DNA, 444 bp, Homo sapiens; identical to SEQ ID NO: 535027
  misc_feature: HIJSMM301CROSB.8.73.G07.1.454.light.4.raw

SEQ ID NO: 604544 - DNA, 447 bp, Homo sapiens; identical to SEQ ID NO: 535201
  misc_feature: HIJSMM301CL9P1.18.9.A09.1.454.light.4.raw

SEQ ID NO: 604545 - DNA, 517 bp, Homo sapiens
  misc_feature: HIJSMM301CG3M1.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcgcctacggaccgaacggtaggaaagtactaacgacgaacctagtggcgtgcgaccactctcgtcttctactcttcccgt

SEQ ID NO: 604546 - DNA, 503 bp, Homo sapiens; identical to SEQ ID NO: 588003
  misc_feature: HIJSMM301C92FF.21.22.B11.1.454.light.4.raw

SEQ ID NO: 604547 - DNA, 444 bp, Homo sapiens
  misc_feature: HIJSMM301C4LOC.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctcgttcccgccctcctcgacacgcga

SEQ ID NO: 604548 - DNA, 508 bp, Homo sapiens; identical to SEQ ID NO: 536388
  misc_feature: HIJSMM301D0A8F.11.57.F02.1.454.light.4.raw

SEQ ID NO: 604549 - DNA, 491 bp, Homo sapiens; identical to SEQ ID NO: 542310
  misc_feature: HIJSMM301DVLJE.22.65.F10.1.454.light.4.raw

SEQ ID NO: 604550 - DNA, 484 bp, Homo sapiens
  misc_feature: HIJSMM301AJM0P.11.17.B06.1.454.light.4.raw
cgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaacagagttacagtaccccgtggaccgttcggtccaagggaccgaaggtaggaaatacaaacgaaactgtaggctgca

SEQ ID NO: 604551 - DNA, 505 bp, Homo sapiens; identical to SEQ ID NO: 583562
  misc_feature: HIJSMM301DV0ET.9.12.B01.1.454.light.4.raw

SEQ ID NO: 604552 - DNA, 513 bp, Homo sapiens
  misc_feature: HIJSMM301D3527.22.36.D03.1.454.light.4.raw
acatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccaactcatcatttatggtgtcactcgtcggccctcaggagtctctcatcgcttctcaggctccaagtctggcaacacggcctccctaaccatctctgggctccagtttgaggacgaggtctacttattactgcagttcctttaaattaggcgccactctcgtggttttcggcggaggcaccgaagtgaccgtcctcggtcagcccaaggctgccccctcggtcact

SEQ ID NO: 604553 - DNA, 487 bp, Homo sapiens; identical to SEQ ID NO: 548740
  misc_feature: HIJSMM301B6CNG.19.71.G05.1.454.light.4.raw

SEQ ID NO: 604554 - DNA, 513 bp, Homo sapiens
  misc_feature: HIJSMM301C9BTM.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggccgagggaccgaaggtaggaaggtacaaacgaactagtggctgcaccatctgtcttctatccttcccgcctact

SEQ ID NO: 604555 - DNA, 420 bp, Homo sapiens; identical to SEQ ID NO: 540533
  misc_feature: HIJSMM301AXDK3.9.34.D01.1.454.light.4.raw

SEQ ID NO: 604556 - DNA, 491 bp, Homo sapiens; identical to SEQ ID NO: 544803
  misc_feature: HIJSMM301C46VG.21.9.A09.1.454.light.4.raw

SEQ ID NO: 604557 - DNA, 508 bp, Homo sapiens; identical to SEQ ID NO: 554667
  misc_feature: HIJSMM301EL2HM.2.21.B10.1.454.light.4.raw

SEQ ID NO: 604558 - DNA, 489 bp, Homo sapiens; identical to SEQ ID NO: 543840
  misc_feature: HIJSMM301C8WVU.12.88.H11.1.454.light.4.raw

SEQ ID NO: 604559 - DNA, 511 bp, Homo sapiens; identical to SEQ ID NO: 583021
  misc_feature: HIJSMM301CD9GB.19.59.F04.1.454.light.4.raw

SEQ ID NO: 604560 - DNA, 515 bp, Homo sapiens
  misc_feature: HIJSMM301B6VRU.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagccgtgatgaggctgacttattttgtcaggtgtgggacagcagcatttatgtcttcggacctgggaccaaggtcaccgtcctaggtcagcccaaggcccaaccccactgtcactctcgttcccgccctcctcga

SEQ ID NO: 604561 - DNA, 494 bp, Homo sapiens; identical to SEQ ID NO: 545180
  misc_feature: HIJSMM301CIN9Z.11.81.H04.1.454.light.4.raw

SEQ ID NO: 604562 - DNA, 487 bp, Homo sapiens; identical to SEQ ID NO: 536206
  misc_feature: HIJSMM301CNQ9F.47.38.D05.1.454.light.4.raw

SEQ ID NO: 604563 - DNA, 483 bp, Homo sapiens; identical to SEQ ID NO: 571581
  misc_feature: HIJSMM301DHB3M.40.8.A08.1.454.light.4.raw

SEQ ID NO: 604564 - DNA, 496 bp, Homo sapiens
  misc_feature: HIJSMM301ASDJE.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaaatcagcagagtggaggctgaggatgttggggttttagttacttgcatgcaagctctacaaactccttacactttgtcacgggacgaagctggaggatcaaacgaaactagt

SEQ ID NO: 604565 - DNA, 494 bp, Homo sapiens; identical to SEQ ID NO: 534992
  misc_feature: HIJSMM301BREOH.9.1.A01.1.454.light.4.raw

SEQ ID NO: 604566 - DNA, 488 bp, Homo sapiens; identical to SEQ ID NO: 537260
  misc_feature: HIJSMM301EXRPR.47.70.G04.1.454.light.4.raw

SEQ ID NO: 604567 - DNA, 384 bp, Homo sapiens
  misc_feature: HIJSMM301AI2IC.41.26.C04.1.454.light.4.raw
tctatactatcacgaccggtgctcgatttagtctagcgactttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccgaaggtggagatcaaacgaactgtggctgcaccatctgtcttcatcttcccgccatctgaatagtataga

SEQ ID NO: 604568 - DNA, 501 bp, Homo sapiens
  misc_feature: HIJSMM301A8OTK.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtctaggtcagcccaaggccaacccactg

SEQ ID NO: 604569 - DNA, 515 bp, Homo sapiens
  misc_feature: HIJSMM301DPW7V.8.43.D10.1.454.light.4.raw
ctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttatagtacaaacaacagacactcctggaccccctgcccggttctcaggctccctccttggggccaaagctgccctgacactgtcaggtgtgcagcctgaggacgaggctgagtattactgcctgctctattatggtgggccttgggtgttcggcggagggaccaagctgaccgtcctaggtcagcccaaggctgccccctcggtcactctgttcccgcctcctcgacacgcg

SEQ ID NO: 604570 - DNA, 485 bp, Homo sapiens
  misc_feature: HIJSMM301EQQWT.4.41.D08.1.454.light.4.raw
agcactgtagcacgaccggtgctcgatttagtcacgcgagaaagggaaagggggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagcctgggcgagcccctaaactcctgatctatggtgcatcaagtctgcaaagtggggtcccatcgaggttcagaggcagtggatctgggacagatttcactctcaccatcagcggcctgcagcctgaagattatgcaacttactattgtcagagttctaattctttcccgcgcacgtttggccaggggaccaaggtagagatcaaacgaactagtggctgcaccat

SEQ ID NO: 604571 - DNA, 498 bp, Homo sapiens
  misc_feature: HIJSMM301DEG7Y.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccaaggtgaccgtcctacgtcagcccaaggctgccccctcggtcactcttcg

SEQ ID NO: 604572 - DNA, 519 bp, Homo sapiens; identical to SEQ ID NO: 597113
  misc_feature: HIJSMM301EI65Z.27.23.C01.1.454.light.4.raw

SEQ ID NO: 604573 - DNA, 508 bp, Homo sapiens; identical to SEQ ID NO: 535835
  misc_feature: HIJSMM301DUFKF.8.34.D01.1.454.light.4.raw

SEQ ID NO: 604574 - DNA, 504 bp, Homo sapiens; identical to SEQ ID NO: 542411
  misc_feature: HIJSMM301APB5Q.9.53.E09.1.454.light.4.raw

SEQ ID NO: 604575 - DNA, 507 bp, Homo sapiens; identical to SEQ ID NO: 561702
  misc_feature: HIJSMM301AEO2C.5.24.C02.1.454.light.4.raw

SEQ ID NO: 604576 - DNA, 511 bp, Homo sapiens
  misc_feature: HIJSMM301COTUJ.48.14.B03.1.454.light.4.raw
agtatacatacacgaccggtgctcgatttagtgtgagtagttccgcggggtgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggttccaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccaagggacccgggtggaaataaaacgaactagtggctgcaccatctgtcttcatt

SEQ ID NO: 604577 - DNA, 486 bp, Homo sapiens; identical to SEQ ID NO: 535385
  misc_feature: HIJSMM301C3Z1Z.19.71.G05.1.454.light.4.raw

SEQ ID NO: 604578 - DNA, 499 bp, Homo sapiens
  misc_feature: HIJSMM301AJ7L0.43.71.G05.1.454.light.4.raw
tgtgagtagtcacgaccggtgctcgatttagtgtcgtcgcaagagagagggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccggaactgtggctgcaccatctgtcttcta

SEQ ID NO: 604579 - DNA, 500 bp, Homo sapiens
  misc_feature: HIJSMM301AFG4U.47.64.F09.1.454.light.4.raw
agctcacgtacacgaccggtgctcgatttagcgcgtatacaagggggagggaactgctcagttaaggacccagagggaaccatggaagccccagctctagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccagggtcggagatcaaacgaactgtggctgcaccatctgtcttcacttcc

SEQ ID NO: 604580 - DNA, 473 bp, Homo sapiens; identical to SEQ ID NO: 535262
  misc_feature: HIJSMM301D3MQI.8.67.G01.1.454.light.4.raw

SEQ ID NO: 604581 - DNA, 483 bp, Homo sapiens
  misc_feature: HIJSMM301ECHHS.52.4.A04.1.454.light.4.raw
cgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgttctggagataaaatggaggataaatatgtttcctggtatcgccagaagccaggccagtcgcctgtcctggtcatctatcacgataagaagcggccctcagggatccctgagcgattctctggctccaactctgggaacacagccactctgaccatcagcgggacccaggctatggatgaggctgactattactgtcagccgtgggacagaagcactctggtgttcggcggagggaccaggcctgaccgtcctaggtcagcccaaggctcgccccccg

SEQ ID NO: 604582 - DNA, 491 bp, Homo sapiens
  misc_feature: HIJSMM301EJ5H5.52.71.G05.1.454.light.4.raw
cgcagtacgacacgaccggtgctcgatttagtgtcgtcgcaagagagagggggtgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtggcttgagctctggctcagtctctcctaatttctaccccagctggtaccagcagaccccaggccaggctccacgcacgctcatctacagcacaattactcgctcttctggggtccctgatcgcttctctggctccatccttgggaacaaagctgccctaaccatcacgggggcccaggcagatgatgaatctgattattactgtgtcctctatatggtagtggcatttggatgttcggcggagggaccaagctgaccgtcctgggtcagcccg

SEQ ID NO: 604583 - DNA, 475 bp, Homo sapiens; identical to SEQ ID NO: 537570
  misc_feature: HIJSMM301AI34D.13.4.A04.1.454.light.4.raw

SEQ ID NO: 604584 - DNA, 486 bp, Homo sapiens; identical to SEQ ID NO: 535043
  misc_feature: HIJSMM301CHPM3.46.35.D02.1.454.light.4.raw

SEQ ID NO: 604585 - DNA, 480 bp, Homo sapiens; identical to SEQ ID NO: 535442
  misc_feature: HIJSMM301DXGQX.41.17.B06.1.454.light.4.raw

SEQ ID NO: 604586 - DNA, 488 bp, Homo sapiens; identical to SEQ ID NO: 536861
  misc_feature: HIJSMM301DV3M3.12.88.H11.1.454.light.4.raw

SEQ ID NO: 604587 - DNA, 498 bp, Homo sapiens
  misc_feature: HIJSMM301CG3DB.12.86.H09.1.454.light.4.raw
atacgacgtacacgaccggtgctcgatttagtgctatagacttgggtttgggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaagggccactggcatcccagccaggttcagtggcagtgggtctggggcagacttcactctcaccatcagcagcctagagcctgaagattttgcagtttattactgtcagcagcgtagcaactggcctcggttcacttttggccaggggaccaagctggagatcaacgaactgtggctgcaccatctgtcttcatt

SEQ ID NO: 604588 - DNA, 506 bp, Homo sapiens; identical to SEQ ID NO: 565966
  misc_feature: HIJSMM301B5XKN.19.85.H08.1.454.light.4.raw

SEQ ID NO: 604589 - DNA, 483 bp, Homo sapiens; identical to SEQ ID NO: 545413
  misc_feature: HIJSMM301C51DP.16.81.H04.1.454.light.4.raw

SEQ ID NO: 604590 - DNA, 499 bp, Homo sapiens; identical to SEQ ID NO: 545732
  misc_feature: HIJSMM301BU01O.3.33.C11.1.454.light.4.raw

SEQ ID NO: 604591 - DNA, 509 bp, Homo sapiens
  misc_feature: HIJSMM301AIFOB.18.59.F04.1.454.light.4.raw
tacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgatttattactgcagctcatatacaagcaccagcactctctatgtcttcggaactgggaccaaggtcaccgtcctaggtcagcccaaggcccaaacccccta

SEQ ID NO: 604592 - DNA, 479 bp, Homo sapiens
  misc_feature: HIJSMM301D34G8.5.70.G04.1.454.light.4.raw
atcagacacgcacgaccggtgctcgatttagtgtagtgtgaagggaaagggggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctgaagattttgctaacttacttttgtcaacaggctcagagtttcccgctcactttcggcggagggaccaaggtggagatcaacgaactgtggctgca

SEQ ID NO: 604593 - DNA, 506 bp, Homo sapiens
  misc_feature: HIJSMM301C883O.4.10.A10.1.454.light.4.raw
agcactgtagcacgaccggtgctcgatttagcgtcgatctcagggggggtagagaagacaggactcaggacaatctccagcatggccagcttccctctcctcctcaccctcctcactcactgtgcagggtcctgggcccactctgtgctgactcagccaccctcagcgtctgggacccccgggcagagggtcaccatctcttgttctggaagcacctccaacatcggaagtaatcctgtaaactggttccagcaactcccaggaagggcccccaaagtcctcatctatggtcagaatcagcgtccctcaggggtccctgaccgattctctggctccaagtctgacacctcagcctccctggccatcagtgggctccagtctgaggatgaggctgattattactgtgcaacatgggatgacatcctacgtggtgcggtgttcggcggagggaccaagttgaccgtcctgggtcagcccaaggctgccccctggtcactctgttccca

SEQ ID NO: 604594 - DNA, 520 bp, Homo sapiens; identical to SEQ ID NO: 537173
  misc_feature: HIJSMM301B0FOD.27.23.C01.1.454.light.4.raw

SEQ ID NO: 604595 - DNA, 499 bp, Homo sapiens; identical to SEQ ID NO: 557364
  misc_feature: HIJSMM301AU3XC.40.57.F02.1.454.light.4.raw

SEQ ID NO: 604596 - DNA, 483 bp, Homo sapiens; identical to SEQ ID NO: 535413
  misc_feature: HIJSMM301AEVOM.26.78.H01.1.454.light.4.raw

SEQ ID NO: 604597 - DNA, 520 bp, Homo sapiens
  misc_feature: HIJSMM301EFR8P.51.27.C05.1.454.light.4.raw
cgatcgtatacacgaccggtgctcgatttagacgcgatcgaaggggtttggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccgcccaggcaaagcccccaaactcatgatttatgatgtcagtgatcggccctcaggggtttcgaatcgcttctctggctccaagtccggcaacacggcctccctgaccatctctgggctccaggccgaggacgaggctgattattactgcacctcatatacaagcagcaacaattgggtgttcggcggagggaccaagctgaccgtcctaggtcagcccaaggctgccccctcggtcactctgttcccccg

SEQ ID NO: 604598 - DNA, 496 bp, Homo sapiens; identical to SEQ ID NO: 541772
  misc_feature: HIJSMM301CRL0T.51.81.H04.1.454.light.4.raw

SEQ ID NO: 604599 - DNA, 476 bp, Homo sapiens; identical to SEQ ID NO: 536632
  misc_feature: HIJSMM301A2XXV.52.1.A01.1.454.light.4.raw

SEQ ID NO: 604600 - DNA, 520 bp, Homo sapiens
  misc_feature: HIJSMM301A5P7Z.14.7.A07.1.454.light.4.raw
cgtctagtaccacgaccggtgctcgatttagcacgtgtcgcagggggccctgaggaaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtcttttggggtccctgatcgcttctctggctccatccttgggaacaaggctgcccctcaccatcacgggggcccaggcagatgatgaatctaattatcactgtgcgttgtattattgggttttggctagttttcggtgtttcgggcggagggacccaggtgaccgtcctacgtcagcccaagg

SEQ ID NO: 604601 - DNA, 506 bp, Homo sapiens
  misc_feature: HIJSMM301BJE5T.9.71.G05.1.454.light.4.raw
tgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagattattcggcggagggaccaggctgaccgtcctgagtcagcccaaggctgtccccccg

SEQ ID NO: 604602 - DNA, 492 bp, Homo sapiens
  misc_feature: HIJSMM301D1RO4.49.58.F03.1.454.light.4.raw
agtcgagagacacgaccggtgctcgatttagtctgatcgagaagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctggtcagccaaggccaacccactgtcact

SEQ ID NO: 604603 - DNA, 490 bp, Homo sapiens
  misc_feature: HIJSMM301A9KOT.48.43.D10.1.454.light.4.raw
agtatacatacacgaccggtgctcgatttagactagcagtaagggggctggtcacacttcttgcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtcaccctcacttgccgggcaagtcaggccatttccaattctttagcctggtatcagcagaaaccaggacaaactcctacactcctgatctatgatgcgtccagtttagagagtggggccccatcgaggttcagcggcagtggatcagggacagagttcactctcaccatcagcagcctgcagcctgaagattttgcaacttattactgtcaacactttaacaattacctcataagccgttcggccaagggacccaggtaggaaaccaagcgaactagt

SEQ ID NO: 604604 - DNA, 506 bp, Homo sapiens
  misc_feature: HIJSMM301A0JJR.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaactgaccgtcctaggtcagcccaaggctcgccccctcggtcactctgtt

SEQ ID NO: 604605 - DNA, 500 bp, Homo sapiens
  misc_feature: HIJSMM301CTEHO.52.34.D01.1.454.light.4.raw
cgcagtacgacacgaccggtgctcgatttagatcgtctgtgttgggtttgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgctagtttattactgtcagcagcgtagcaactggcctccgatcaccttcggccaagggacacgactggagattaaacgaactgtggctgcaccatctgtcttcat

SEQ ID NO: 604606 - DNA, 511 bp, Homo sapiens; identical to SEQ ID NO: 549837
  misc_feature: HIJSMM301EPMNU.15.34.D01.1.454.light.4.raw

SEQ ID NO: 604607 - DNA, 483 bp, Homo sapiens; identical to SEQ ID NO: 542200
  misc_feature: HIJSMM301BDE47.7.75.G09.1.454.light.4.raw

SEQ ID NO: 604608 - DNA, 463 bp, Homo sapiens
  misc_feature: HIJSMM301A9NI7.49.75.G09.1.454.light.4.raw
agtcgagagacacgaccggtgctcgatttagtatagacatcagggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccagggacagcccctaaactcctgatcctcgatgcatccactttggaaacaggggtcccatcaaggttcagtggaagtggctctgggacagtattttactttcaccatcagcaggctgcagcctgaagatattgcaacatattactgtcaacagtatgatagtctcccgctcactttcggcgggggacgaaggtggagatcaagcgaa

SEQ ID NO: 604609 - DNA, 470 bp, Homo sapiens
  misc_feature: HIJSMM301D4TAY.49.33.C11.1.454.light.4.raw
agtcgagagacacgaccggtgctcgatttagagtgagctcgttgggtttgggggagtcagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcatcacctactatttaaattggtatcagcaaaaacccagggaaagcccctaagctcctgatctatgctgcatccaatctgcaaagtggggtcccatcaaggttcagtggcagtggatctgggacagatttcaccctcaccatcagcagtctgcaacctgatgattttgcaacttattattgtcaacagagttacagtatcccgtacacttttggccaggggaccaggctggatatcagacgaa

SEQ ID NO: 604610 - DNA, 501 bp, Homo sapiens
  misc_feature: HIJSMM301CLUZ1.48.41.D08.1.454.light.4.raw
agtatacatacacgaccggtgctcgatttagtcacgcgagaaagggaaagggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaagggacacgactggagattaaacgaactgtggctgcaccatctgtcttcactcttcccc

SEQ ID NO: 604611 - DNA, 484 bp, Homo sapiens; identical to SEQ ID NO: 550098
  misc_feature: HIJSMM301B24X7.26.78.H01.1.454.light.4.raw

SEQ ID NO: 604612 - DNA, 440 bp, Homo sapiens
  misc_feature: HIJSMM301C7OO6.41.9.A09.1.454.light.4.raw
tctatactatcacgaccggtgctcgatttagcgagacgcgcagggtcctgggcccagtctgtcctgactcagccaccctcagcgtctgggacccccgggcagacggtgaccatctcctgttctggaagcagttccaacatcggaagtaataatgtgaattggtaccggcaactcccaggaacggcccccaaactcctcatacatagtaatgatcatcggccccctggggtccctgaccgaatctctggctccaggtctggcgcctcagcctccctggtcattagtgggctccagtctgacgatgaggctgactattactgttcagcgtgggatgccagcccgaatcattgggtgttcggcggagggaccaaactgaccgtcctaggtcagcccaaggctgccccctcggtcactctgttcccaccctcctcatgtataga

SEQ ID NO: 604613 - DNA, 491 bp, Homo sapiens; identical to SEQ ID NO: 572228
  misc_feature: HIJSMM301AJRYG.8.4.A04.1.454.light.4.raw

SEQ ID NO: 604614 - DNA, 503 bp, Homo sapiens; identical to SEQ ID NO: 535044
  misc_feature: HIJSMM301D4539.19.78.H01.1.454.light.4.raw

SEQ ID NO: 604615 - DNA, 508 bp, Homo sapiens
  misc_feature: HIJSMM301C71EZ.9.33.C11.1.454.light.4.raw
tgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaaattgagatcaaacgaactagtggctgcacatctgtctcatcttcccg

SEQ ID NO: 604616 - DNA, 487 bp, Homo sapiens; identical to SEQ ID NO: 560779
  misc_feature: HIJSMM301C14WU.17.25.C03.1.454.light.4.raw

SEQ ID NO: 604617 - DNA, 505 bp, Homo sapiens; identical to SEQ ID NO: 586937
  misc_feature: HIJSMM301CBB4R.9.53.E09.1.454.light.4.raw

SEQ ID NO: 604618 - DNA, 508 bp, Homo sapiens
  misc_feature: HIJSMM301AS155.10.70.G04.1.454.light.4.raw
catagtagtgcacgaccggtgctcgatttagtgtagtgtgaagggaaagggggggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggttatgatgtacactggtaccagcaacttcccggaacagcccccacgctcctcatctatggtgacaccaaccggccctcaggggtccctgagcgattctctgggtccaagtctggcacctcggcctccctggccatcactgggctccaggctgaggatgaggctgattattactgccagtcccatgacaacagcctgagtgtttgggtgttcggcggagggaccaagctgaccgtccttagtcagcccaaggctgccccctcggtcactctgttcccaccctccctccta

SEQ ID NO: 604619 - DNA, 494 bp, Homo sapiens; identical to SEQ ID NO: 541183
  misc_feature: HIJSMM301BQNN1.19.71.G05.1.454.light.4.raw

SEQ ID NO: 604620 - DNA, 510 bp, Homo sapiens; identical to SEQ ID NO: 543290
  misc_feature: HIJSMM301D5TOW.5.58.F03.1.454.light.4.raw

SEQ ID NO: 604621 - DNA, 504 bp, Homo sapiens
  misc_feature: HIJSMM301C2ZQA.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggagtgttggggtttattactgcatgcaaactacacacggccgctcactttcggcggagggaccaaggtaggagagcaaacgaactgtggctgcaccatc

SEQ ID NO: 604622 - DNA, 504 bp, Homo sapiens; identical to SEQ ID NO: 536385
  misc_feature: HIJSMM301DUIMA.27.78.H01.1.454.light.4.raw

SEQ ID NO: 604623 - DNA, 447 bp, Homo sapiens; identical to SEQ ID NO: 535020
  misc_feature: HIJSMM301CEW3A.18.9.A09.1.454.light.4.raw

SEQ ID NO: 604624 - DNA, 502 bp, Homo sapiens
  misc_feature: HIJSMM301BD0FL.48.24.C02.1.454.light.4.raw
agtatacatacacgaccggtgctcgatttagtacagatcgttagggaaagggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacaatattattatactccgccgacgttcggccggggaccaacgtggaaatcaaacgaactgtggctgcaccatct

SEQ ID NO: 604625 - DNA, 493 bp, Homo sapiens
  misc_feature: HIJSMM301BU52P.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacacgtacccccctctactttcggcggagggaccgaaggcggagatcagaacgaactgtggctgcaccatctgtcttcta

SEQ ID NO: 604626 - DNA, 515 bp, Homo sapiens; identical to SEQ ID NO: 555401
  misc_feature: HIJSMM301EE5J2.15.34.D01.1.454.light.4.raw

SEQ ID NO: 604627 - DNA, 493 bp, Homo sapiens
  misc_feature: HIJSMM301BOH9S.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgtcggccaaggaccaaagtaggacgatcaagcgaactagtggcgtgcaccatctgtt

SEQ ID NO: 604628 - DNA, 488 bp, Homo sapiens; identical to SEQ ID NO: 535725
  misc_feature: HIJSMM301BXFN2.12.88.H11.1.454.light.4.raw

SEQ ID NO: 604629 - DNA, 507 bp, Homo sapiens; identical to SEQ ID NO: 597017
  misc_feature: HIJSMM301ERHWO.13.11.A11.1.454.light.4.raw

SEQ ID NO: 604630 - DNA, 494 bp, Homo sapiens; identical to SEQ ID NO: 534994
  misc_feature: HIJSMM301A00QJ.27.78.H01.1.454.light.4.raw

SEQ ID NO: 604631 - DNA, 505 bp, Homo sapiens; identical to SEQ ID NO: 542298
  misc_feature: HIJSMM301DM6ZG.14.3.A03.1.454.light.4.raw

SEQ ID NO: 604632 - DNA, 505 bp, Homo sapiens
  misc_feature: HIJSMM301APEAJ.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggtcggagggaccaaaactagaggtcaacgaactagtggctgcaccatctgtcttcatt

SEQ ID NO: 604633 - DNA, 501 bp, Homo sapiens; identical to SEQ ID NO: 550407
  misc_feature: HIJSMM301DM5YH.4.39.D06.1.454.light.4.raw

SEQ ID NO: 604634 - DNA, 509 bp, Homo sapiens
  misc_feature: HIJSMM301BY3QN.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccggtcctaggtcagcccaaggctgccccctggtcactctgtt

SEQ ID NO: 604635 - DNA, 505 bp, Homo sapiens; identical to SEQ ID NO: 535503
  misc_feature: HIJSMM301EAHW6.8.28.C06.1.454.light.4.raw

SEQ ID NO: 604636 - DNA, 494 bp, Homo sapiens; identical to SEQ ID NO: 553467
  misc_feature: HIJSMM301C5Z4R.13.67.G01.1.454.light.4.raw

SEQ ID NO: 604637 - DNA, 495 bp, Homo sapiens; identical to SEQ ID NO: 536487
  misc_feature: HIJSMM301CO5E5.52.86.H09.1.454.light.4.raw

SEQ ID NO: 604638 - DNA, 491 bp, Homo sapiens
  misc_feature: HIJSMM301B02AP.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcgtccgaagggaccgaaggtaggaaagtacaaacgaacgtagtggctgcaccta

SEQ ID NO: 604639 - DNA, 498 bp, Homo sapiens
  misc_feature: HIJSMM301ED2CS.41.18.B07.1.454.light.4.raw
tctatactatcacgaccggtgctcgatttagtcgctgcgtaagggggggagcctagctgtggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcggggggaccgaagctgaccgtcctaggtcagcccaaggctccg

SEQ ID NO: 604640 - DNA, 476 bp, Homo sapiens; identical to SEQ ID NO: 560169
  misc_feature: HIJSMM301ASJS6.12.1.A01.1.454.light.4.raw

SEQ ID NO: 604641 - DNA, 517 bp, Homo sapiens; identical to SEQ ID NO: 563089
  misc_feature: HIJSMM301C3N7B.8.87.H10.1.454.light.4.raw

SEQ ID NO: 604642 - DNA, 507 bp, Homo sapiens
  misc_feature: HIJSMM301CL3W0.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcgccatcagcagcctggagcctgaagatattgcagtttattattgtcagcagcgtagcaggtggcctttcactttcggcccggggaccaaagtggaaatcaaacgaactgtggctgcaccatctgtcttcatcttcccgcc

SEQ ID NO: 604643 - DNA, 487 bp, Homo sapiens
  misc_feature: HIJSMM301DL2LI.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtgggtcccatcaaggttcagtggcgccggatctgggacaggaattcactctcaccatcagcgggctccagtctgaggactctgcaacttattactgccaacaatatgatatttattctccagcgttcggccaggggaccaaggtgaagtcaagcgaactgtggctgcaccatctgt

SEQ ID NO: 604644 - DNA, 494 bp, Homo sapiens; identical to SEQ ID NO: 534994
  misc_feature: HIJSMM301CQMKC.27.78.H01.1.454.light.4.raw

SEQ ID NO: 604645 - DNA, 480 bp, Homo sapiens
  misc_feature: HIJSMM301DEG5X.40.59.F04.1.454.light.4.raw
tctagcgactcacgaccggtgctcgatttagtacacacacttagggattgggggggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggtcggagggaccaagctgaccgtcctaagtcagcccaagg

SEQ ID NO: 604646 - DNA, 514 bp, Homo sapiens
  misc_feature: HIJSMM301AGD6B.40.46.E02.1.454.light.4.raw
tctagcgactcacgaccggtgctcgatttagactcatctacagggaaagggggggcctaaggaagcagcactggtggtgcctcagccatggcctggaccgttctcctcctcggcctcctctctcactgcacagggtctgtgacctcctatgtgctgactcagccactctcggtgtctgtggccccaggacaggcggccaatgttacctgtgggggagacaacattgggagtaaaagtgtgcactggtaccagctgaagccaggccaggcccctgtgttggtcgtctttggacatggtgcccgaccctcggggatccctgagcgattctctgcctccaggtctgggaacacggccaccctgaccatcaccagggtcgaggccggagatgaggccgactattttgtcacgtgtggcacgttagtcatcacgtcttcggaactgggaccacggtcaccgtcctaagtcagcccaaggccaaccccactgtcactctgttccccaccctcctcagtcg

SEQ ID NO: 604647 - DNA, 495 bp, Homo sapiens; identical to SEQ ID NO: 535007
  misc_feature: HIJSMM301C9RBG.22.5.A05.1.454.light.4.raw

SEQ ID NO: 604648 - DNA, 486 bp, Homo sapiens; identical to SEQ ID NO: 535043
  misc_feature: HIJSMM301ETJTU.46.35.D02.1.454.light.4.raw

SEQ ID NO: 604649 - DNA, 444 bp, Homo sapiens; identical to SEQ ID NO: 535856
  misc_feature: HIJSMM301D6O0D.9.9.A09.1.454.light.4.raw

SEQ ID NO: 604650 - DNA, 508 bp, Homo sapiens; identical to SEQ ID NO: 589920
  misc_feature: HIJSMM301D0ZE3.47.85.H08.1.454.light.4.raw

SEQ ID NO: 604651 - DNA, 547 bp, Homo sapiens
  misc_feature: HIJSMM301A0G7T.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgccagtcctatgacactagcgagtcgagtcgttaccgtatagttctttcgggaacttcgggtaccggaacggtacgtaccgtacccgtacgtacgtacgaccgacccgaacggacccccaaccctcgtcgta

SEQ ID NO: 604652 - DNA, 484 bp, Homo sapiens; identical to SEQ ID NO: 535400
  misc_feature: HIJSMM301BRJU7.46.26.C04.1.454.light.4.raw

SEQ ID NO: 604653 - DNA, 484 bp, Homo sapiens
  misc_feature: HIJSMM301BC2BT.47.46.E02.1.454.light.4.raw
agctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcacagcctgcagtctgaagattttgcagtttattactgtcagcagtatcataactggccgctcaccttcggccaagggacacgactggagattaaacgaactgtggctgcaccat

SEQ ID NO: 604654 - DNA, 497 bp, Homo sapiens
  misc_feature: HIJSMM301A9DY4.52.34.D01.1.454.light.4.raw
cgcagtacgacacgaccggtgctcgatttagatcgtctgtgttgggtttgggggtgggtccaggaggcagaactctgggtgtctcaccatggcctggatccctctacttctccccctcctcactctctgcacaggctctggggcctcctatgaactggcacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcggagggaccaagctgaccgtcctaggtcagcccaagctgccccctcggtcta

SEQ ID NO: 604655 - DNA, 504 bp, Homo sapiens; identical to SEQ ID NO: 537401
  misc_feature: HIJSMM301D6A05.51.23.C01.1.454.light.4.raw

SEQ ID NO: 604656 - DNA, 489 bp, Homo sapiens
  misc_feature: HIJSMM301DHW5J.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatggaggctgattattactgcagctcatatgcaggcatcaacactgttttcggcggagggaccaagctgaccgtcctaggtcagcccaaggctgccccctcggtcactctgttcccaccctcctcga

SEQ ID NO: 604657 - DNA, 444 bp, Homo sapiens
  misc_feature: HIJSMM301CHUM9.10.76.G10.1.454.light.4.raw
catagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctaattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccaccctcctccactactatg

SEQ ID NO: 604658 - DNA, 494 bp, Homo sapiens; identical to SEQ ID NO: 536974
  misc_feature: HIJSMM301EGTGH.16.86.H09.1.454.light.4.raw

SEQ ID NO: 604659 - DNA, 489 bp, Homo sapiens
  misc_feature: HIJSMM301BFBHJ.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtcggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatcttttatgttcttcggatctgggaccagggtcaccgtcctaggtcagcccaaggccaaccca

SEQ ID NO: 604660 - DNA, 494 bp, Homo sapiens; identical to SEQ ID NO: 539922
  misc_feature: HIJSMM301BG1WJ.27.78.H01.1.454.light.4.raw

SEQ ID NO: 604661 - DNA, 422 bp, Homo sapiens; identical to SEQ ID NO: 447881
  misc_feature: HIJSMM301AY6RL.9.34.D01.1.454.light.4.raw

SEQ ID NO: 604662 - DNA, 519 bp, Homo sapiens
  misc_feature: HIJSMM301BXM8H.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcgggacccagaccctggagcctcagttggaagcagccgatccagcctgcggagcctgtggggcaggtcagcccaaggcctgccccctcggtcactctcgttcccgccctcctccacg

SEQ ID NO: 604663 - DNA, 485 bp, Homo sapiens; identical to SEQ ID NO: 535880
  misc_feature: HIJSMM301CFOA1.7.75.G09.1.454.light.4.raw

SEQ ID NO: 604664 - DNA, 489 bp, Homo sapiens
  misc_feature: HIJSMM301AU68E.47.36.D03.1.454.light.4.raw
agctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattggcaactggttagcctggtatcaacagaaaccagggaaacgcccctaacctcctcatctctactgcatccactttgcaaagtcgggtccatcaaggttcagcgcagtggatctgggacagatttcactctcactatcagcagcctgcagcctgaagtatttggaacttattattgtcaacagggtaacagtttcccgctcaccttcggcggagggaccaaggtggagatagaaaagaactgtggctgcaccat

SEQ ID NO: 604665 - DNA, 491 bp, Homo sapiens; identical to SEQ ID NO: 564744
  misc_feature: HIJSMM301BG2U1.41.2.A02.1.454.light.4.raw

SEQ ID NO: 604666 - DNA, 499 bp, Homo sapiens; identical to SEQ ID NO: 544831
  misc_feature: HIJSMM301CMAGS.41.53.E09.1.454.light.4.raw

SEQ ID NO: 604667 - DNA, 485 bp, Homo sapiens; identical to SEQ ID NO: 535363
  misc_feature: HIJSMM301AP5OY.17.26.C04.1.454.light.4.raw

SEQ ID NO: 604668 - DNA, 521 bp, Homo sapiens; identical to SEQ ID NO: 539470
  misc_feature: HIJSMM301BUJM9.27.23.C01.1.454.light.4.raw

SEQ ID NO: 604669 - DNA, 521 bp, Homo sapiens; identical to SEQ ID NO: 562813
  misc_feature: HIJSMM301B61C9.10.86.H09.1.454.light.4.raw

SEQ ID NO: 604670 - DNA, 490 bp, Homo sapiens
  misc_feature: HIJSMM301EEER8.48.42.D09.1.454.light.4.raw
agtatacatacacgaccggtgctcgatttagacacatacgcagggaaagggggaagagctgctcagttaggacccagagggaaccatggaaaccccagcgcagcttctcttcctcctgctactctggctcccagatagcaccggagaaatcgtgttgacgcagtctccaggcaccctgtctgtgtctccaggggaaagagccaccctctcctgcagggccagtcagagtgttagcagcagctacttagcctggtaccagcagaaaccgggccaggctcccaggctcctcatctatggtgcatccagcagggccactggcatcccagacaggttcagttgcagtgggtctgggacagacttcactctcaccatcagcagactggagcctgaagattttgcaatttattactgtcagcagtatggtacctcacccaggtaccacttttggccaggggaccaagctggagatcaaacgaactgtggctgcacc

SEQ ID NO: 604671 - DNA, 479 bp, Homo sapiens
  misc_feature: HIJSMM301A6KLF.3.53.E09.1.454.light.4.raw
agacgcactccacgaccggtgctcgatttagagagagtgtgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagaagccagggaaagcccctaacctcctgatctatgatgcctccagtttggcaagtggggtcccatcaaggttcagcggcagtggatctgggacagaattcactctcaccatcagcagcctgcagcctgatgattttgcaacttattactgccaacagtataatacccgcgtgacgttcggccaagggaccaaggtggagatcatacgaactgtggctgcacc

SEQ ID NO: 604672 - DNA, 512 bp, Homo sapiens
  misc_feature: HIJSMM301EJKNJ.17.28.C06.1.454.light.4.raw
  modified_base (232)..(232): a, c, t, g, unknown or other
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacngctccggcatctcaactaaacatttttgctggtaccagcaattcccaggatcggccccccatcctcatctatagaaatgatcatcggccctccggggtccctgaccgattctctggctccatgtctggcacctcacgcctccctgaccatccagtgggctccggtccgaggatgaggctgattattactgtgcaccgtgggatgacatcctgaatggtccggtgttcggcggaggaccgaggctgaccgtcctaagtcacgcccaaggcctcgccccctc

SEQ ID NO: 604673 - DNA, 495 bp, Homo sapiens; identical to SEQ ID NO: 538651
  misc_feature: HIJSMM301D4RKG.10.79.H02.1.454.light.4.raw

SEQ ID NO: 604674 - DNA, 493 bp, Homo sapiens; identical to SEQ ID NO: 539187
  misc_feature: HIJSMM301DZZDQ.14.30.C08.1.454.light.4.raw

SEQ ID NO: 604675 - DNA, 508 bp, Homo sapiens; identical to SEQ ID NO: 536388
  misc_feature: HIJSMM301ECU8D.11.57.F02.1.454.light.4.raw

SEQ ID NO: 604676 - DNA, 497 bp, Homo sapiens
  misc_feature: HIJSMM301BQ3K5.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctggggacagacttcactctcaccatcagcagactggagcctgaggattttgcagtgtattactgtcagcagtatcataggtacaaacaccttacggccaagggacacgactggagattaaaggaactgtggctgcaccatctgtcttcatcttccccg

SEQ ID NO: 604677 - DNA, 476 bp, Homo sapiens
  misc_feature: HIJSMM301D1E12.12.49.E05.1.454.light.4.raw
atacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagctaattttttagcctggtatcagcagaaaccagggaaagttccacacctcctgatctatgctgcatccgctttgcaatcaggggtcccatctcggttcagcggcagtggatctgggacagagttcactctcaccatcagcagcctgcagcctgaagatgttgcaacttattactgtcaaaagtataacagtcgcccccttcaccttcggccaagggacacgactggagattagaacg

SEQ ID NO: 604678 - DNA, 501 bp, Homo sapiens
  misc_feature: HIJSMM301BUWGX.5.24.C02.1.454.light.4.raw
atcagacacgcacgaccggtgctcgatttagtacagatcgttagggaaagggggctggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcagggtccctgatcgcttctctggctccaagtctggcaacacggcctccctgaccgtctctggctccaggctgaggatgaggctgattattactgcagctcatatgcaggcagcagcagtccccatgtgatcttcggcggggggaccaagctgaccgtcctaggtcagcccaaggccg

SEQ ID NO: 604679 - DNA, 521 bp, Homo sapiens
  misc_feature: HIJSMM301BTXCJ.13.38.D05.1.454.light.4.raw
tcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggtccaacgggaccgaaggtacgggaaatacaacgacgaaccgtagtggcgtggcaccaactctcgtcttcctatcttcccgt

SEQ ID NO: 604680 - DNA, 508 bp, Homo sapiens
  misc_feature: HIJSMM301EMOT5.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaagggtcggacctcaaacgaactgtggctgcaccatctgtcttcatccttcccgcc

SEQ ID NO: 604681 - DNA, 512 bp, Homo sapiens; identical to SEQ ID NO: 562621
  misc_feature: HIJSMM301EH5RW.7.34.D01.1.454.light.4.raw

SEQ ID NO: 604682 - DNA, 488 bp, Homo sapiens; identical to SEQ ID NO: 549410
  misc_feature: HIJSMM301ET8P6.52.35.D02.1.454.light.4.raw

SEQ ID NO: 604683 - DNA, 487 bp, Homo sapiens; identical to SEQ ID NO: 541444
  misc_feature: HIJSMM301DKXJX.19.71.G05.1.454.light.4.raw

SEQ ID NO: 604684 - DNA, 495 bp, Homo sapiens
  misc_feature: HIJSMM301ATQQ9.11.10.A10.1.454.light.4.raw
cgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccaggggaaagagccaccctctcctgcagggccagtcagagtgttaggagcaacttagcctggtaccagcagaaacctggccaggctcccaggctcctcatctatggtgcatccaccagggccactggtttcccagccaggttcagtggcagtgggtctgagacagagttcactctcaccatcaacggcctgcagtctgaagattttgcagtttattactgtcagcagtataataactggcctcggacgttcggccaagggaccaaggtggaagtacaacgaactagtggctgcaccatctgtcttcatcttcccg

SEQ ID NO: 604685 - DNA, 491 bp, Homo sapiens; identical to SEQ ID NO: 544714
  misc_feature: HIJSMM301EBL2S.18.11.A11.1.454.light.4.raw

SEQ ID NO: 604686 - DNA, 503 bp, Homo sapiens
  misc_feature: HIJSMM301CFRPF.48.35.D02.1.454.light.4.raw
agtatacatacacgaccggtgctcgatttagcacacgatagttgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggaggaccaagctgacctcctaagtcacgcccaaggctgccccctcggtcactctccg

SEQ ID NO: 604687 - DNA, 487 bp, Homo sapiens
  misc_feature: HIJSMM301BVAN1.52.25.C03.1.454.light.4.raw
cgcagtacgacacgaccggtgctcgatttagtagtgtagatttgggtttggggcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatggtgcatcaactttgcaaggtggggtcccatcaaggttcagcggcagtggatctgggacagaattcactctcacaatcagcagcctgcagcctgaagattttgcaacttattactgtcaacaccttaatagttactccttcactttcggccctgggaccaaagtggacatcaaacgaactgtggctgcaccatctgtctt

SEQ ID NO: 604688 - DNA, 517 bp, Homo sapiens
  misc_feature: HIJSMM301DAGC4.40.74.G08.1.454.light.4.raw
tctagcgactcacgaccggtgctcgatttagtagctctatcaggggggggaagctcagcttcagctgtgggtagagaagacaggactcaggacaatctccagcatggccagcttccctctcctcctcaccctcctcactcactgtgcagggtcctgggcccagtctgtcctgactcagccaccctcagcgtctgggacccccgggcagacggtgaccatctcctgttctggaagcagttccaacatcggaagtaataatgtgaattggtaccggcaactcccaggaacggcccccaaactcctcatacatagtaatgatcatcggccccctggggtccctgaccgaatctctggctccaggtctggcgcctcagcctccctggtcattagtgggctccagtctgacgatgaggctgactattactgttcaggcgtgggatgccagcccgaatcattgggtgttcggcggagggaccaaactgaccgtcctaggtcagcccaaggctgccccctcggt

SEQ ID NO: 604689 - DNA, 514 bp, Homo sapiens
  misc_feature: HIJSMM301C5ZM0.16.83.H06.1.454.light.4.raw
tgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtgggggaaacggccttggacgtaaaagtgtgcactggtaccagcagaagccaggccaggcccctgtgctggtcgtctatgatgatagcgaccggccctcagggatccctgagcgattctctggctccaactctgggaacgcggccaccctgacccatcagcagggtcgaagccggggatgaggccgactattactgtcaggtgtgggatagtagtagtgatcattatgtcttcggatctgggaccagggtcaccgtcctaggtcagcccaaggccaaccccactgtcactctgttcccaccct

SEQ ID NO: 604690 - DNA, 497 bp, Homo sapiens
  misc_feature: HIJSMM301CARRH.51.59.F04.1.454.light.4.raw
cgatcgtatacacgaccggtgctcgatttagtacacacacttagggattgggggggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggcccaacccactgtcactctcg

SEQ ID NO: 604691 - DNA, 505 bp, Homo sapiens; identical to SEQ ID NO: 536117
  misc_feature: HIJSMM301CVKQE.8.71.G05.1.454.light.4.raw

SEQ ID NO: 604692 - DNA, 494 bp, Homo sapiens
  misc_feature: HIJSMM301B64A9.22.57.F02.1.454.light.4.raw
acatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggtctggtatcagcagaaaccagggaaagcccctatactcctgatccacaaggcgtctactttagaaagtggggtcccatcaaggttcagcggcactggatctgggacagaattcactctcaccatcaacagcctgcagcctgatgatttggcaacttactactgccaaccgtatagtacttattcggtcaccttcggccaagggacacgactggagattaaacgaactgtggctgcaccatctgtcttcatt

SEQ ID NO: 604693 - DNA, 478 bp, Homo sapiens; identical to SEQ ID NO: 549111
  misc_feature: HIJSMM301EYGKY.16.86.H09.1.454.light.4.raw

SEQ ID NO: 604694 - DNA, 503 bp, Homo sapiens
  misc_feature: HIJSMM301AS3BO.43.57.F02.1.454.light.4.raw
tgtgagtagtcacgaccggtgctcgatttagctcgatatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtcccctggacagtcagtcaccatctcctgcactggaagcagcagtgacattggtggttatacatatgtctcctggtaccaacagcacccaggcaaagcccccaaactcatgatttatgaggtcaataagcggccgtcaggggtccctgatcgcttctctggctccaagtctggcaacacggccacctgaccgtctctgggctccaggctgaggatgaggctcattattactgcagctcatatacaggcaacaagaatttggtgttcggcggagggaccgagctgaccgtcctaggtcagcccaaggctgccccctcggt

SEQ ID NO: 604695 - DNA, 512 bp, Homo sapiens
  misc_feature: HIJSMM301BIGZX.22.36.D03.1.454.light.4.raw
acatacgcgtcacgaccggtgctcgatttagctgcgtcacgatctctcttgggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggccaaaccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaattaggcgccactctcgtggttttcggcggaggcaccgaagtgaccgtctcggtcagccaaggctgcccctcggtcactc

SEQ ID NO: 604696 - DNA, 474 bp, Homo sapiens; identical to SEQ ID NO: 570103
  misc_feature: HIJSMM301EIQ9E.13.48.E04.1.454.light.4.raw

SEQ ID NO: 604697 - DNA, 489 bp, Homo sapiens; identical to SEQ ID NO: 535139
  misc_feature: HIJSMM301AZCJU.14.55.E11.1.454.light.4.raw

SEQ ID NO: 604698 - DNA, 518 bp, Homo sapiens
  misc_feature: HIJSMM301AP9M0.9.86.H09.1.454.light.4.raw
tgatacgtctcacgaccggtgctcgatttagtgctatagacttgggtttggggggggtcacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatcaccatctcctgcactggaaccagcattgggagttttaaccttgtctcctggtaccaacaccacccaggcaaagcccccaaactcatgatttatgaagtcactaagcggccctcggggatttctgctcgcttctctggctccaagtccgtcaacacggcctccctgacaatctctgggctccagactgaggacgaggctcattattactgttgctcatatacaggtgtaagtagttgggtgttcggcggagggaccaagctgaccgtcctaggtcagcccaaggctgccccctcggtcactctgttcccacctcctc

SEQ ID NO: 604699 - DNA, 477 bp, Homo sapiens
  misc_feature: HIJSMM301C74CX.51.87.H10.1.454.light.4.raw
cgatcgtatacacgaccggtgctcgatttagcagtactgcgttgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggcggggggaccgaaggtggaggatcaagcgaactgtggctgca

SEQ ID NO: 604700 - DNA, 495 bp, Homo sapiens
  misc_feature: HIJSMM301EXRDI.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggaccgaaggtggagttcaaacgaactagtggctgcaccatctgtcttcat

SEQ ID NO: 604701 - DNA, 468 bp, Homo sapiens; identical to SEQ ID NO: 565102
  misc_feature: HIJSMM301B37FT.11.70.G04.1.454.light.4.raw

SEQ ID NO: 604702 - DNA, 498 bp, Homo sapiens
  misc_feature: HIJSMM301AQQ4I.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgatttactactgctgctcatatgcaggtcgtatctcttatgtcttcggaactgggaccaaggtcaccgtcctaggtcagcccaaggccaacccca

SEQ ID NO: 604703 - DNA, 502 bp, Homo sapiens; identical to SEQ ID NO: 537816
  misc_feature: HIJSMM301BWE31.19.78.H01.1.454.light.4.raw

SEQ ID NO: 604704 - DNA, 493 bp, Homo sapiens; identical to SEQ ID NO: 540880
  misc_feature: HIJSMM301A7T3O.40.81.H04.1.454.light.4.raw

SEQ ID NO: 604705 - DNA, 494 bp, Homo sapiens; identical to SEQ ID NO: 534992
  misc_feature: HIJSMM301CSTII.9.1.A01.1.454.light.4.raw

SEQ ID NO: 604706 - DNA, 482 bp, Homo sapiens
  misc_feature: HIJSMM301CVTSX.17.39.D06.1.454.light.4.raw
cgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaaacctggccaggctcccaggctcctcatgtatggtgcatctaccagggccactggtgtcccagccaggttcagtggcagtgggtctgggacagagttctctctcatcatcagcagcctgcagtctgaagattttgcggtttattactgtcagcagtataatcagtggcctccgtggacgttcggcaagggaccaaggtggaaatcaaacgaactgtg

SEQ ID NO: 604707 - DNA, 491 bp, Homo sapiens; identical to SEQ ID NO: 602162
  misc_feature: HIJSMM301CJBSB.10.17.B06.1.454.light.4.raw

SEQ ID NO: 604708 - DNA, 493 bp, Homo sapiens; identical to SEQ ID NO: 535084
  misc_feature: HIJSMM301ENF4J.47.64.F09.1.454.light.4.raw

SEQ ID NO: 604709 - DNA, 448 bp, Homo sapiens; identical to SEQ ID NO: 534998
  misc_feature: HIJSMM301ES0X2.18.9.A09.1.454.light.4.raw

SEQ ID NO: 604710 - DNA, 498 bp, Homo sapiens
  misc_feature: HIJSMM301B9R6I.40.53.E09.1.454.light.4.raw
tctagcgactcacgaccggtgctcgatttagagagagtgtgttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgctgctcttatgcaggcagtttcgctctcgaagtgttcggcggagggaccgagctgaccgtcctacgtcagcccaaggctccg

SEQ ID NO: 604711 - DNA, 493 bp, Homo sapiens
  misc_feature: HIJSMM301AX21W.43.32.C10.1.454.light.4.raw
tgtgagtagtcacgaccggtgctcgatttagtatagacatcaacacacaaagggggagctacaacaggcaggcaggggcagcaagatggtgttgcagacccaggtcttcatttctctgttgctctggatctctggtgcctacggggacttcgtgatgacccagtctccagactccctggctgtgtcgctgggcgacagggccaccatcgactgcaagtccagccagagtgttttatacagctccaacaataagaactacttagcttggtaccagcataaaccaggacagactcctaaactgctcatttactgggcttctacccgggaatccggggtccctgaccgattcagtggcagcgggtctgggacagatttcactctcaccatcagcagcctgcaggctgaagatgtggcagtttattactgtcaacaatattatactattccgtacagttttggccaggggaccaagctggagatcaacgaactgtgg

SEQ ID NO: 604712 - DNA, 507 bp, Homo sapiens; identical to SEQ ID NO: 563344
  misc_feature: HIJSMM301EZWYQ.3.79.H02.1.454.light.4.raw

SEQ ID NO: 604713 - DNA, 501 bp, Homo sapiens; identical to SEQ ID NO: 538461
  misc_feature: HIJSMM301BQIAM.13.11.A11.1.454.light.4.raw

SEQ ID NO: 604714 - DNA, 484 bp, Homo sapiens
  misc_feature: HIJSMM301D4HVK.43.60.F05.1.454.light.4.raw
tgtgagtagtcacgaccggtgctcgatttagtacgtcatcaggggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaagcccctaagctcctgatctatgctgcatccactttacaaaatggagtcccatcaagattcagcggcagtggatctggcacagctttcactctcaccgtcagcagcctgcagtctgaagtattttgctaacttattactgtctacaagattcttcttacctcggacgtcgcgacggacgacggtcggatgtacagcgaacgtgtgtcgtgcaccact

SEQ ID NO: 604715 - DNA, 484 bp, Homo sapiens; identical to SEQ ID NO: 536162
  misc_feature: HIJSMM301DRQAC.13.59.F04.1.454.light.4.raw

SEQ ID NO: 604716 - DNA, 487 bp, Homo sapiens; identical to SEQ ID NO: 559194
  misc_feature: HIJSMM301A8WJY.19.71.G05.1.454.light.4.raw

SEQ ID NO: 604717 - DNA, 481 bp, Homo sapiens; identical to SEQ ID NO: 535993
  misc_feature: HIJSMM301DN53M.21.25.C03.1.454.light.4.raw

SEQ ID NO: 604718 - DNA, 508 bp, Homo sapiens; identical to SEQ ID NO: 550887
  misc_feature: HIJSMM301ELX0T.4.57.F02.1.454.light.4.raw

SEQ ID NO: 604719 - DNA, 445 bp, Homo sapiens; identical to SEQ ID NO: 574804
  misc_feature: HIJSMM301CHFGK.14.76.G10.1.454.light.4.raw

SEQ ID NO: 604720 - DNA, 491 bp, Homo sapiens; identical to SEQ ID NO: 589120
  misc_feature: HIJSMM301ETEPR.12.51.E07.1.454.light.4.raw

SEQ ID NO: 604721 - DNA, 478 bp, Homo sapiens; identical to SEQ ID NO: 541545
  misc_feature: HIJSMM301BOEI4.10.74.G08.1.454.light.4.raw

SEQ ID NO: 604722 - DNA, 492 bp, Homo sapiens; identical to SEQ ID NO: 540973
  misc_feature: HIJSMM301BJ3D4.43.20.B09.1.454.light.4.raw

SEQ ID NO: 604723 - DNA, 474 bp, Homo sapiens; identical to SEQ ID NO: 580149
  misc_feature: HIJSMM301DVFNF.7.81.H04.1.454.light.4.raw

SEQ ID NO: 604724 - DNA, 492 bp, Homo sapiens
  misc_feature: HIJSMM301AVASG.22.5.A05.1.454.light.4.raw
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctggccaggctcccaggctcctcatctatgatgcatcttacagggccactggcatcccagccaggttcagtggcagtgggtctgggacagacttcactctcaccatcagcagcctagagcctgaagattttgcagtttattactgtcagcagcgtagcaactcctcacgttcggcggagggaccaaggtggagatcaaacgaactgtggctgcacatctgtcttcatcttccgcc

SEQ ID NO: 604725 - DNA, 498 bp, Homo sapiens; identical to SEQ ID NO: 536879
  misc_feature: HIJSMM301A4BRD.22.14.B03.1.454.light.4.raw

SEQ ID NO: 604726 - DNA, 479 bp, Homo sapiens; identical to SEQ ID NO: 535118
  misc_feature: HIJSMM301BQRJV.13.59.F04.1.454.light.4.raw

SEQ ID NO: 604727 - DNA, 511 bp, Homo sapiens; identical to SEQ ID NO: 558744
  misc_feature: HIJSMM301B97YV.4.57.F02.1.454.light.4.raw

SEQ ID NO: 604728 - DNA, 525 bp, Homo sapiens
  misc_feature: HIJSMM301B8N4G.47.53.E09.1.454.light.4.raw
agctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcgggatgaggccgtatattttgtcaggtgtgggagactaatttggtcgatatgttggttcggcggacgggacaagcgtcgaccgtccgtcggtcacgccgaacggctccgccccgtcgtcactctcgtcccaccctcctacg

SEQ ID NO: 604729 - DNA, 493 bp, Homo sapiens
  misc_feature: HIJSMM301BDTRR.52.38.D05.1.454.light.4.raw
cgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgatatgcttattggtaccagcagaagccgggccaggccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtctggtcagcccaaggccaacccactgtcact

SEQ ID NO: 604730 - DNA, 509 bp, Homo sapiens; identical to SEQ ID NO: 536363
  misc_feature: HIJSMM301AUPR6.17.33.C11.1.454.light.4.raw

SEQ ID NO: 604731 - DNA, 497 bp, Homo sapiens
  misc_feature: HIJSMM301CQW3L.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttccccaccctcctcgagtgcgtct

SEQ ID NO: 604732 - DNA, 478 bp, Homo sapiens; identical to SEQ ID NO: 535129
  misc_feature: HIJSMM301A8P55.11.11.A11.1.454.light.4.raw

SEQ ID NO: 604733 - DNA, 491 bp, Homo sapiens
  misc_feature: HIJSMM301DXH2S.15.3.A03.1.454.light.4.raw
tctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtatcagaaaaaccaggacagcctcctaagctgctcatttactgggcatctacccgggaatccggggtccctgaccgattcagtggcagcgggtctggcacagatttcactctcaccatcagcagcctgcaggctgaagatgtggcagtttattactgtcagcaatatagtaaagtattccttttactttcggccctgggaccaaagtggatatcaaacgaactgtgctgtcaca

SEQ ID NO: 604734 - DNA, 494 bp, Homo sapiens
  misc_feature: HIJSMM301EMXM5.51.77.G11.1.454.light.4.raw
cgatcgtatacacgaccggtgctcgatttagctagtcactcaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgctgctcacatgcaggcagcatcggtgtgctattcggcggagggaccaagctgaccgtcctaggtcagcccaagg

SEQ ID NO: 604735 - DNA, 555 bp, Homo sapiens
  misc_feature: HIJSMM301BG9DB.14.57.F02.1.454.light.4.raw
cgtctagtaccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcacaggcttacagaacgctcccctacccaacaacgcataagcgtcgctgccgcagcttcggtgcatggtttacgccccgttacactccttcccgccatctgagtactagacg

SEQ ID NO: 604736 - DNA, 493 bp, Homo sapiens
  misc_feature: HIJSMM301C1BT6.48.44.D11.1.454.light.4.raw
agtatacatacacgaccggtgctcgatttagcgcagtacgaagggggagctacaacaggcaggcaggggcagcaagatggtgttgcagacccaggtcttcatttctctgttgctctggatctctggtgcctacggggacgtcgtgatgacccagtctccagactccctggcagtgtctctgggcgggagggccaccatcaactgcaagtccagccagagtattttatacagctcctacaataagagcgacttagcttggtaccagcagaaaccaggacagcctcctaagttgctcatttactgggcatctaaccggcaatccggggtccctgaccgattcagtggcagcgggtctgggacacatttcgctttcaccatcagcagcctgcaggctgaggatgtggcagtttatactgtcagcaatattatactactccgtggactttcggccaagggaccaaggtggaaatcagacgaactgtggctgcaccat

SEQ ID NO: 604737 - DNA, 492 bp, Homo sapiens
  misc_feature: HIJSMM301C8NIV.22.65.F10.1.454.light.4.raw
  modified_base (419)..(419): a, c, t, g, unknown or other
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaaacctgaagatttcgcaacttactactgtcaaacagacttacagtnccccccgatcaccttcgccaagggacacgactgagattaaacgaaactgtggcgtgcaccatctctcttcatt

SEQ ID NO: 604738 - DNA, 480 bp, Homo sapiens
  misc_feature: HIJSMM301BWPAB.13.76.G10.1.454.light.4.raw
tcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggagcagctccaacattggggcacattatgatgtacactggtaccagcagtttccaggagcaggtcccagactcctcatcaatagtaacaacaatcggcccgcaggggtccctgaccgattctctggctccaggtctggcacctcagcctccctggtcatcactgggctccaggctgaggatgaggctgattatttctgccagtcctatgacagcagcctgagtgcttcggtagttcgggcggggggacccac

SEQ ID NO: 604739 - DNA, 503 bp, Homo sapiens
  misc_feature: HIJSMM301CYOMF.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaacccttcggccaacgggacgacgactggagattaaaggaaacgtagtggcgtgcaccatctgtcttctatcttccccg

SEQ ID NO: 604740 - DNA, 516 bp, Homo sapiens
  misc_feature: HIJSMM301EMTQE.5.59.F04.1.454.light.4.raw
atcagacacgcacgaccggtgctcgatttagtacacacacttagggattgggggaagagctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgttcggtccaacgggaccgaacggtaggaaagtacaaacgaaactagtggcgtgcaccactctgtcttctatcttccccg

SEQ ID NO: 604741 - DNA, 441 bp, Homo sapiens; identical to SEQ ID NO: 534971
  misc_feature: HIJSMM301DDVYW.11.3.A03.1.454.light.4.raw

SEQ ID NO: 604742 - DNA, 453 bp, Homo sapiens; identical to SEQ ID NO: 594220
  misc_feature: HIJSMM301B8UQA.19.86.H09.1.454.light.4.raw

SEQ ID NO: 604743 - DNA, 491 bp, Homo sapiens; identical to SEQ ID NO: 535294
  misc_feature: HIJSMM301DE7V4.16.68.G02.1.454.light.4.raw

SEQ ID NO: 604744 - DNA, 491 bp, Homo sapiens; identical to SEQ ID NO: 535176
  misc_feature: HIJSMM301D4T34.13.39.D06.1.454.light.4.raw

SEQ ID NO: 604745 - DNA, 374 bp, Homo sapiens; identical to SEQ ID NO: 559434
  misc_feature: HIJSMM301CR2ND.49.45.E01.1.454.light.4.raw

SEQ ID NO: 604746 - DNA, 484 bp, Homo sapiens; identical to SEQ ID NO: 536162
  misc_feature: HIJSMM301AQ2EF.13.59.F04.1.454.light.4.raw

SEQ ID NO: 604747 - DNA, 453 bp, Homo sapiens
  misc_feature: HIJSMM301BRT8X.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaagctgccccctcggtcactctgttcccaccctcctccacgagagta

SEQ ID NO: 604748 - DNA, 495 bp, Homo sapiens; identical to SEQ ID NO: 535821
  misc_feature: HIJSMM301D9MRJ.3.31.C09.1.454.light.4.raw

SEQ ID NO: 604749 - DNA, 501 bp, Homo sapiens; identical to SEQ ID NO: 555551
  misc_feature: HIJSMM301CQ5TT.21.81.H04.1.454.light.4.raw

SEQ ID NO: 604750 - DNA, 499 bp, Homo sapiens
  misc_feature: HIJSMM301BOFRX.19.78.H01.1.454.light.4.raw
tactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtcactctgttccccacctcctccacgagagta

SEQ ID NO: 604751 - DNA, 493 bp, Homo sapiens; identical to SEQ ID NO: 544335
  misc_feature: HIJSMM301AKBVU.5.57.F02.1.454.light.4.raw

SEQ ID NO: 604752 - DNA, 503 bp, Homo sapiens; identical to SEQ ID NO: 552400
  misc_feature: HIJSMM301D1OZV.27.78.H01.1.454.light.4.raw
  modified_base (431)..(431): a, c, t, g, unknown or other

SEQ ID NO: 604753 - DNA, 496 bp, Homo sapiens; identical to SEQ ID NO: 535541
  misc_feature: HIJSMM301BR03O.3.33.C11.1.454.light.4.raw

SEQ ID NO: 604754 - DNA, 505 bp, Homo sapiens
  misc_feature: HIJSMM301AGEVK.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtgggagagagccacacaattgatggccaagacggttgggtgttcggcggagggaccaagctgaccgtcctaggtcagcccaaggctgccccctggtcactctgttcccgccctcctcg

SEQ ID NO: 604755 - DNA, 472 bp, Homo sapiens
  misc_feature: HIJSMM301ER196.52.59.F04.1.454.light.4.raw
  modified_base (415)..(415): a, c, t, g, unknown or other
cgcagtacgacacgaccggtgctcgatttagtacacacacttagggattggggaggacacagcatggacatgagggtccctgctcagctcctgggactcctgctgctctggctcccagataccagatgtgacatccagatgacccagtctccatcctccctgtctgcatctgttggagacagagtcaccatctcttgccgggcgagtcaggtcattaacagttatttagcctggtatcagcaaaaaccagggcaagttcctgaactcctgatctatgacacatccactttgcaatcaggggtcccatctcggttcgttggcagtgggtctgggacagattttactctcaccatcagcagcctgcagcctgaagatgttgcaacttatttctgtcataactatgatgatgcccctnacacgttcggccaagggaccaagctggaaatcaaacgactgtggctgcaccatctgt

SEQ ID NO: 604756 - DNA, 494 bp, Homo sapiens; identical to SEQ ID NO: 534994
  misc_feature: HIJSMM301D70ZW.27.78.H01.1.454.light.4.raw

SEQ ID NO: 604757 - DNA, 486 bp, Homo sapiens; identical to SEQ ID NO: 535043
  misc_feature: HIJSMM301DPJV3.46.35.D02.1.454.light.4.raw

SEQ ID NO: 604758 - DNA, 507 bp, Homo sapiens
  misc_feature: HIJSMM301DR35X.48.67.G01.1.454.light.4.raw
agtatacatacacgaccggtgctcgatttagagtatacatattgggtttgggggaggaacgtgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaagcctggccaggctcccagactcctcatctatgatgcgtctaccagggccactggcgtcccggccaggttcagtgccaggtgggtctgggacagacttcactctcaccatcagcagcctagacgcccgaagtattttgcggtttattactgtcagcagcgtgccaactggcctctcacgttcggcggagggaccaaggtggacatcaaacgactgtggctgcaccatctgtcttcatccttccccg

SEQ ID NO: 604759 - DNA, 505 bp, Homo sapiens
  misc_feature: HIJSMM301APD2U.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctcaaggctgaggacgaggctgattactactgctgctcatatgcaggtcgtatctcttatgtcttcggaactgggaccaaggtcaccgtcctaggtcagcccaaggccaaccccactgtca

SEQ ID NO: 604760 - DNA, 484 bp, Homo sapiens; identical to SEQ ID NO: 535240
  misc_feature: HIJSMM301D8CF6.47.60.F05.1.454.light.4.raw

SEQ ID NO: 604761 - DNA, 495 bp, Homo sapiens
  misc_feature: HIJSMM301BMOU9.16.49.E05.1.454.light.4.raw
tgtactactccacgaccggtgctcgatttagagcgactagcaacacacaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccagcagcacccagacaaagcccccaaactcatgatttatgagggcaataagcggccctcaggagtttctaatcgcttctctggctccacgtctggcaacacggcctccctgacaatctctggcctccaggctgaggacgaggctgattattactgctgctcatattcaagtcgtgtcactatgctttttggcggagggaccaaggtgaccgtcctaggtcagcccaaggct

SEQ ID NO: 604762 - DNA, 416 bp, Homo sapiens; identical to SEQ ID NO: 539343
  misc_feature: HIJSMM301C86C6.18.78.H01.1.454.light.4.raw

SEQ ID NO: 604763 - DNA, 479 bp, Homo sapiens; identical to SEQ ID NO: 541538
  misc_feature: HIJSMM301CCSXV.48.51.E07.1.454.light.4.raw

SEQ ID NO: 604764 - DNA, 504 bp, Homo sapiens
  misc_feature: HIJSMM301CRPAK.48.86.H09.1.454.light.4.raw
agtatacatacacgaccggtgctcgatttagtgctatagacttgggtttgggggagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttccccg

SEQ ID NO: 604765 - DNA, 473 bp, Homo sapiens; identical to SEQ ID NO: 541472
  misc_feature: HIJSMM301BVGKO.5.12.B01.1.454.light.4.raw

SEQ ID NO: 604766 - DNA, 484 bp, Homo sapiens; identical to SEQ ID NO: 535240
  misc_feature: HIJSMM301DN896.47.60.F05.1.454.light.4.raw

SEQ ID NO: 604767 - DNA, 506 bp, Homo sapiens
  misc_feature: HIJSMM301A4BCB.13.36.D03.1.454.light.4.raw
tcacgtactacacgaccggtgctcgatttagctgcgtcacgatctctcttggggagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggcagagtgtcaccatctcttgttctggaggcagtgccaacatcgggagtaattatgcattctggtatcaacaactcccaggaacggcccccagactcctcatctatagcaataaccagcggccctcaggggtccctgaccgattctctggctccaagtctggcacctcagcctccctggccatcagtgggctccggtccgacgatgaggctgattattactgttcagcttgggatgacagcctgaatactttgggttttcggcggagggaccaagttgaccgccctaggtcagcccaaggctccg

SEQ ID NO: 604768 - DNA, 446 bp, Homo sapiens
  misc_feature: HIJSMM301DK9O1.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccctctccatactcgta

SEQ ID NO: 604769 - DNA, 513 bp, Homo sapiens
  misc_feature: HIJSMM301DK7A3.43.59.F04.1.454.light.4.raw
tgtgagtagtcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgaccatctctgggctccaggctgaggacgaggctgattattactgcaactcacttacaacgaccgacacttgcgtattcggcggcgggaccaagctgaccgtcctaggtcagcccaaggctgccccctcggtcattctgtt

SEQ ID NO: 604770 - DNA, 520 bp, Homo sapiens
  misc_feature: HIJSMM301CFHR6.12.71.G05.1.454.light.4.raw
atacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagcccaaggctgccccctcggtcactctgttcccacct

SEQ ID NO: 604771 - DNA, 521 bp, Homo sapiens; identical to SEQ ID NO: 539470
  misc_feature: HIJSMM301EKDDE.27.23.C01.1.454.light.4.raw

SEQ ID NO: 604772 - DNA, 512 bp, Homo sapiens; identical to SEQ ID NO: 552150
  misc_feature: HIJSMM301DUJ92.17.33.C11.1.454.light.4.raw

SEQ ID NO: 604773 - DNA, 483 bp, Homo sapiens
  misc_feature: HIJSMM301A2IQC.47.62.F07.1.454.light.4.raw
  modified_base (478)..(478): a, c, t, g, unknown or other
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagccctaagctcctgatctacgatgcatccaatttggaaacaggggtcccatcaaggttcagtggaagtggatctgggacagtattttactttcaccatcagcagcctgcagcctgaagatattgcaaacatattactgtcaacagtatcataatctcccacttcggcctggaccaagtggatatcaaacgaactgtggctgcacactntcgtt

SEQ ID NO: 604774 - DNA, 502 bp, Homo sapiens
  misc_feature: HIJSMM301BW8C7.18.59.F04.1.454.light.4.raw
tacgagtatgcacgaccggtgctcgatttagtacacacacttagggagttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtctaggtcagcccaaggccaaccca

SEQ ID NO: 604775 - DNA, 485 bp, Homo sapiens; identical to SEQ ID NO: 536576
  misc_feature: HIJSMM301D72DU.46.35.D02.1.454.light.4.raw

SEQ ID NO: 604776 - DNA, 502 bp, Homo sapiens; identical to SEQ ID NO: 537816
  misc_feature: HIJSMM301A8SKJ.19.78.H01.1.454.light.4.raw

SEQ ID NO: 604777 - DNA, 487 bp, Homo sapiens; identical to SEQ ID NO: 548963
  misc_feature: HIJSMM301CXQVX.26.23.C01.1.454.light.4.raw

SEQ ID NO: 604778 - DNA, 506 bp, Homo sapiens
  misc_feature: HIJSMM301C0TCB.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggaccctgcccgattctcaggctccctccttggggcaaagctgccctgacactgtctggtgtgcagcctgaggacgaggctgactattactgcctactctactttggtggtgctgtgctattcggcggagggccaagctgacctcttaagtcagcccaaggctgccccctcggtcactctgttcccta

SEQ ID NO: 604779 - DNA, 504 bp, Homo sapiens
  misc_feature: HIJSMM301EQD7V.10.21.B10.1.454.light.4.raw
catagtagtgcacgaccggtgctcgatttagtgtcgtcgcaagagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccttggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaatagaggtcaaacgaactagtggctgcaccatctgtcttcta

SEQ ID NO: 604780 - DNA, 494 bp, Homo sapiens; identical to SEQ ID NO: 534994
  misc_feature: HIJSMM301A9CW5.27.78.H01.1.454.light.4.raw

SEQ ID NO: 604781 - DNA, 468 bp, Homo sapiens; identical to SEQ ID NO: 585594
  misc_feature: HIJSMM301AXS3L.5.36.D03.1.454.light.4.raw

SEQ ID NO: 604782 - DNA, 510 bp, Homo sapiens; identical to SEQ ID NO: 574761
  misc_feature: HIJSMM301AYBJ3.8.34.D01.1.454.light.4.raw

SEQ ID NO: 604783 - DNA, 496 bp, Homo sapiens; identical to SEQ ID NO: 537925
  misc_feature: HIJSMM301CRYAL.22.14.B03.1.454.light.4.raw

SEQ ID NO: 604784 - DNA, 472 bp, Homo sapiens; identical to SEQ ID NO: 536302
  misc_feature: HIJSMM301CK2DP.18.76.G10.1.454.light.4.raw

SEQ ID NO: 604785 - DNA, 485 bp, Homo sapiens; identical to SEQ ID NO: 540394
  misc_feature: HIJSMM301CZN28.46.26.C04.1.454.light.4.raw

SEQ ID NO: 604786 - DNA, 486 bp, Homo sapiens; identical to SEQ ID NO: 538568
  misc_feature: HIJSMM301D09PD.47.38.D05.1.454.light.4.raw

SEQ ID NO: 604787 - DNA, 487 bp, Homo sapiens; identical to SEQ ID NO: 536272
  misc_feature: HIJSMM301D4EOO.17.25.C03.1.454.light.4.raw

SEQ ID NO: 604788 - DNA, 496 bp, Homo sapiens; identical to SEQ ID NO: 535109
  misc_feature: HIJSMM301AFD4A.16.78.H01.1.454.light.4.raw

SEQ ID NO: 604789 - DNA, 480 bp, Homo sapiens
  misc_feature: HIJSMM301AYWHE.13.36.D03.1.454.light.4.raw
tcacgtactacacgaccggtgctcgatttagctgcgtcacgatctctcttgggggggtcagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggctcctcatttatggtgcatccaccagggccactggtatcccagaccggttcagtggcagtgggtctgggacagacttcactctcaccatcagcagtctgcagtctgaagattttgcagtttattactgtcagcagtataataactggcctccgtacatgtacacttttggccaggggaccaa

SEQ ID NO: 604790 - DNA, 514 bp, Homo sapiens
  misc_feature: HIJSMM301ANSMP.10.75.G09.1.454.light.4.raw
catagtagtgcacgaccggtgctcgatttagtatagacatcaggggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaagtgacattggttctttaaattttgtctcttggtaccaacagagcccagacaaagcccccaaaattatcatttctgctgtcagtaatcggccctcaggggtttctagtcgcttctctggctccaagtctggcaacacggcctccctgaccatctctgggctccaggctgaggacgaggctgattattattgcagctcatatacaaacaccaaagctttgatattcggcggagggaccaaaactgaccgtccttcgtcagcccaacggctgccccctccgtcgactctgttcccta

SEQ ID NO: 604791 - DNA, 484 bp, Homo sapiens
  misc_feature: HIJSMM301EZNM7.47.60.F05.1.454.light.4.raw
  modified_base (429)..(429): a, c, t, g, unknown or other
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccnctcaccttggccaaagggacacgactggagattaaacgaactgtggctgcaccat

SEQ ID NO: 604792 - DNA, 496 bp, Homo sapiens; identical to SEQ ID NO: 595974
  misc_feature: HIJSMM301CQ1GB.9.53.E09.1.454.light.4.raw

SEQ ID NO: 604793 - DNA, 504 bp, Homo sapiens; identical to SEQ ID NO: 550151
  misc_feature: HIJSMM301C515C.2.21.B10.1.454.light.4.raw

SEQ ID NO: 604794 - DNA, 504 bp, Homo sapiens; identical to SEQ ID NO: 557936
  misc_feature: HIJSMM301CHROK.19.78.H01.1.454.light.4.raw

SEQ ID NO: 604795 - DNA, 444 bp, Homo sapiens; identical to SEQ ID NO: 534993
  misc_feature: HIJSMM301C4ELO.5.9.A09.1.454.light.4.raw

SEQ ID NO: 604796 - DNA, 502 bp, Homo sapiens; identical to SEQ ID NO: 537556
  misc_feature: HIJSMM301AM8TA.52.34.D01.1.454.light.4.raw

SEQ ID NO: 604797 - DNA, 446 bp, Homo sapiens; identical to SEQ ID NO: 535364
  misc_feature: HIJSMM301D7JUA.18.9.A09.1.454.light.4.raw

SEQ ID NO: 604798 - DNA, 482 bp, Homo sapiens
  misc_feature: HIJSMM301DBE2A.17.26.C04.1.454.light.4.raw
cgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcggcgagggaccaaggtggagatcaaacgaactgtggctgcacc

SEQ ID NO: 604799 - DNA, 507 bp, Homo sapiens; identical to SEQ ID NO: 550515
  misc_feature: HIJSMM301DFHQM.12.73.G07.1.454.light.4.raw

SEQ ID NO: 604800 - DNA, 501 bp, Homo sapiens
  misc_feature: HIJSMM301DYSIF.15.59.F04.1.454.light.4.raw
tctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacggggcccaggcagatgatgaatctgtttattattgtgtcctatatatgggtgctggcatttcggtcttcggcggaggaccaagctgaccgtcctaggtcagcccaaggctgccccctcggt

SEQ ID NO: 604801 - DNA, 505 bp, Homo sapiens; identical to SEQ ID NO: 550097
  misc_feature: HIJSMM301D71YF.7.71.G05.1.454.light.4.raw

SEQ ID NO: 604802 - DNA, 454 bp, Homo sapiens; identical to SEQ ID NO: 536347
  misc_feature: HIJSMM301CVUP2.19.86.H09.1.454.light.4.raw

SEQ ID NO: 604803 - DNA, 514 bp, Homo sapiens
  misc_feature: HIJSMM301BOHJB.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagatttcactctcaccatcatcagcctggagcctgaagatgttgcagtttattactgtcaacatcgtaccgagtggccgtccgggggccactttcggccctcgggaccgaacggtggagatacaaacgaactgtggctgcaccactctgtcttcta

SEQ ID NO: 604804 - DNA, 505 bp, Homo sapiens; identical to SEQ ID NO: 535987
  misc_feature: HIJSMM301D3ZRP.18.37.D04.1.454.light.4.raw

SEQ ID NO: 604805 - DNA, 502 bp, Homo sapiens; identical to SEQ ID NO: 573981
  misc_feature: HIJSMM301DA022.19.67.G01.1.454.light.4.raw

SEQ ID NO: 604806 - DNA, 503 bp, Homo sapiens; identical to SEQ ID NO: 578541
  misc_feature: HIJSMM301EYZCW.4.39.D06.1.454.light.4.raw

SEQ ID NO: 604807 - DNA, 509 bp, Homo sapiens; identical to SEQ ID NO: 545002
  misc_feature: HIJSMM301A6EQN.14.7.A07.1.454.light.4.raw

SEQ ID NO: 604808 - DNA, 496 bp, Homo sapiens; identical to SEQ ID NO: 551939
  misc_feature: HIJSMM301BHB80.19.71.G05.1.454.light.4.raw

SEQ ID NO: 604809 - DNA, 464 bp, Homo sapiens; identical to SEQ ID NO: 537214
  misc_feature: HIJSMM301AETZM.18.59.F04.1.454.light.4.raw

SEQ ID NO: 604810 - DNA, 486 bp, Homo sapiens; identical to SEQ ID NO: 535385
  misc_feature: HIJSMM301BNSFW.19.71.G05.1.454.light.4.raw

SEQ ID NO: 604811 - DNA, 502 bp, Homo sapiens; identical to SEQ ID NO: 543936
  misc_feature: HIJSMM301BAHPZ.15.1.A01.1.454.light.4.raw

SEQ ID NO: 604812 - DNA, 549 bp, Homo sapiens
  misc_feature: HIJSMM301ASAA4.15.33.C11.1.454.light.4.raw
  modified_base (515)..(515): a, c, t, g, unknown or other
tctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcacaggcttacagaacgctcccctaccaacaacgcataagcgtcgctgccgcagcttcggtgcatggtttancccccgtttcatcttcccgccatctgagctacgt

SEQ ID NO: 604813 - DNA, 522 bp, Homo sapiens
  misc_feature: HIJSMM301EH697.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctcccagcctgaggacgaggctgattattattgtagttcatatacaaccagtgacacttgggtgttcggcggagggaccaggctgaccgtcctaggtcagcccaaggctgccccctcggtcactctgttcccaccct

SEQ ID NO: 604814 - DNA, 476 bp, Homo sapiens
  misc_feature: HIJSMM301DXM6V.13.76.G10.1.454.light.4.raw
tcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtctaagtcagacccg

SEQ ID NO: 604815 - DNA, 496 bp, Homo sapiens
  misc_feature: HIJSMM301DG16L.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccgaggtggaaatcaaacgaactgtggctgcacc

SEQ ID NO: 604816 - DNA, 483 bp, Homo sapiens
  misc_feature: HIJSMM301EEVUD.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacattatttcactctcgccatcagcagcctgcagcctgaagattttgcaacttactattgtcaacaggctaacagtttcccgcttccaccgttcggcggggggaccaaggtggagatcaaacgaactgtggctgcacc

SEQ ID NO: 604817 - DNA, 506 bp, Homo sapiens
  misc_feature: HIJSMM301AZ45K.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgtgtccaggaccaaggtggaaagtacaaacgaactacgtggctgcaccaactctgtcttctatctttccccg

SEQ ID NO: 604818 - DNA, 484 bp, Homo sapiens
  misc_feature: HIJSMM301AW6TY.10.48.E04.1.454.light.4.raw
catagtagtgcacgaccggtgctcgatttagagagcgtcacagagagaagggggaggaactgctcagttaggacccagagggaaccatggaagccccagctcagcttctcttcctcctgctactctggctcccagataccaccggagaaattgtgttgacacagtctccagccaccctgtctttgtctccaggggaaggagccaccctctcctgcagggccagtcagagtgttagcatctacttagcctggttccaacagaaacctggccaggctcccaggctcctcatctataatgcatccaacagggccactggcatcccagccaggttcagtggcagtgggtctgggacagacttcactctcaccatcagcagcctagagcctgaagattttgcagtttattactgtcagcagcgtttcgcctggcctcacacttttggccaggggaccaagctggagatcatgcgaactgtggctgcacc

SEQ ID NO: 604819 - DNA, 514 bp, Homo sapiens
  misc_feature: HIJSMM301DKUYT.15.34.D01.1.454.light.4.raw
tctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggcatttgggtgttcggcggaggggaccaaaactgaccgtcctaggtcagcccaaggctgccccctcggtcactctgttcccaccctcctccgctacgtaga

SEQ ID NO: 604820 - DNA, 496 bp, Homo sapiens
  misc_feature: HIJSMM301CE6M3.10.79.H02.1.454.light.4.raw
catagtagtgcacgaccggtgctcgatttagtgtcacacgaagggaaagggggagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacgaggttcagtggcagtgggtctgggacagacttcactctcaccatcagcagactggagtctgaagattttgcagtgtattattgtcagcaatatggtaggtcacctgggacttttggccaggggaccaagctggagatcaaacgaactgtggctgcaccatctgtcttcta

SEQ ID NO: 604821 - DNA, 490 bp, Homo sapiens; identical to SEQ ID NO: 543909
  misc_feature: HIJSMM301BZYBA.14.55.E11.1.454.light.4.raw
